(12) United States Patent
Savignac et al.

(10) Patent No.: US 11,376,284 B2
(45) Date of Patent: Jul. 5, 2022

(54) COMPOSITIONS COMPRISING BACTERIAL STRAINS

(71) Applicant: 4D Pharma Research Limited, Aberdeen (GB)

(72) Inventors: Helene Savignac, Aberdeen (GB); Imke Elisabeth Mulder, Aberdeen (GB); Alexander James Stevenson, Aberdeen (GB); Ted Dinan, County Cork (IE); John Cryan, County Cork (IE)

(73) Assignee: 4D Pharma Research Limited, Aberdeen (GB)

( * ) Notice: Subject to any disclaimer, the term of this patent is extended or adjusted under 35 U.S.C. 154(b) by 232 days.

(21) Appl. No.: 16/692,667

(22) Filed: Nov. 22, 2019

(65) Prior Publication Data
US 2020/0078417 A1 Mar. 12, 2020

Related U.S. Application Data

(63) Continuation of application No. PCT/GB2018/051389, filed on May 22, 2018.

(30) Foreign Application Priority Data

| May 22, 2017 | (GB) | 1708176 |
| Sep. 6, 2017 | (GB) | 1714298 |
| Sep. 6, 2017 | (GB) | 1714305 |
| Sep. 6, 2017 | (GB) | 1714309 |
| Oct. 9, 2017 | (GB) | 1716493 |
| Nov. 9, 2017 | (GB) | 1718551 |

(51) Int. Cl.
| *A61K 35/74* | (2015.01) |
| *A61P 25/28* | (2006.01) |
| *A61P 25/22* | (2006.01) |
| *A61P 25/18* | (2006.01) |
| *A61P 25/24* | (2006.01) |
| *A61P 25/16* | (2006.01) |
| *A61P 25/00* | (2006.01) |
| *A61K 9/00* | (2006.01) |
| *A61K 35/741* | (2015.01) |
| *A61K 9/48* | (2006.01) |

(52) U.S. Cl.
CPC ............ *A61K 35/74* (2013.01); *A61K 9/0031* (2013.01); *A61K 9/0053* (2013.01); *A61K 9/48* (2013.01); *A61K 35/741* (2013.01); *A61P 25/00* (2018.01); *A61P 25/16* (2018.01); *A61P 25/18* (2018.01); *A61P 25/22* (2018.01); *A61P 25/24* (2018.01); *A61P 25/28* (2018.01)

(58) Field of Classification Search
CPC ........ A61K 35/74; A61K 9/0031; A61K 9/48; A61K 9/0053; A61K 35/741; A61P 25/00; A61P 25/28; A61P 25/22; A61P 25/18; A61P 25/24; A61P 25/16; A23L 33/135; C12N 1/20
See application file for complete search history.

(56) References Cited

U.S. PATENT DOCUMENTS

| 3,817,837 A | 6/1974 | Rubenstein et al. |
| 3,850,752 A | 11/1974 | Schuurs et al. |
| 3,939,350 A | 2/1976 | Kronick et al. |
| 3,996,345 A | 12/1976 | Ullman et al. |
| 4,275,149 A | 6/1981 | Litman et al. |
| 4,277,437 A | 7/1981 | Maggio |
| 4,366,241 A | 12/1982 | Tom et al. |
| 4,683,202 A | 7/1987 | Mullis |
| 4,816,567 A | 3/1989 | Cabilly et al. |
| 5,589,168 A | 12/1996 | Allen et al. |
| 5,599,795 A | 2/1997 | McCann et al. |
| 5,674,707 A | 10/1997 | Hintz et al. |
| 5,741,665 A | 4/1998 | Kato et al. |
| 5,925,657 A | 7/1999 | Seed et al. |
| 5,951,977 A | 9/1999 | Nisbet et al. |
| 6,348,452 B1 | 2/2002 | Brown et al. |
| 6,468,964 B1 | 10/2002 | Rowe et al. |
| 6,645,530 B1 | 11/2003 | Borody |
| 7,101,565 B2 | 9/2006 | Monte |
| 7,485,325 B2 | 2/2009 | Swain |
| 7,625,704 B2 | 12/2009 | Fredricks et al. |
| 7,749,494 B2 | 7/2010 | Renaud et al. |
| 7,998,474 B2 | 8/2011 | Kelly |
| 8,197,805 B2 | 6/2012 | Lin et al. |
| 8,287,932 B2 | 10/2012 | Rosales et al. |
| 8,460,648 B2 | 6/2013 | Borody |

(Continued)

FOREIGN PATENT DOCUMENTS

| CA | 2768301 A1 | 1/2011 |
| CN | 1863540 A | 11/2006 |

(Continued)

OTHER PUBLICATIONS

Luna, R., et al., Gut brain axis: diet microbiota interactions and implications for modulation of anxiety and depression, 2015, Current Opinion in Biotechnology, 32: 35-41 (Year: 2015).*

"Amedei, A. et al. Multiple sclerosis: the role of cytokines in pathogenesis and in therapies. Int J Mol Sci. Oct. 19, 2012;13(10):13438-60. doi: 10.3390/ijms131013438.".

"Campeau, J.L. et al., Intestinal Epithelial Cells Modulate Antigen-Presenting Cell Responses to Bacterial DNA. Infectionand Immunity. Aug. 2012; 80(8): 2632-2644.".

(Continued)

*Primary Examiner* — Louise W Humphrey
*Assistant Examiner* — Anjali Ajit Hirani
(74) *Attorney, Agent, or Firm* — Wilson Sonsini Goodrich & Rosati

(57) ABSTRACT

The invention provides compositions comprising bacterial strains for treating and preventing central nervous system disorders and conditions.

13 Claims, 75 Drawing Sheets

Specification includes a Sequence Listing.

(56) References Cited

U.S. PATENT DOCUMENTS

| | | |
|---|---|---|
| 8,557,233 B2 | 10/2013 | Macsharry et al. |
| 9,011,834 B1 | 4/2015 | Mckenzie et al. |
| 9,314,489 B2 | 4/2016 | Kelly et al. |
| 9,371,510 B2 | 6/2016 | Moore |
| 9,376,473 B2 | 6/2016 | Gleiberman et al. |
| 9,539,293 B2 | 1/2017 | Kelly et al. |
| 9,610,307 B2 | 4/2017 | Berry et al. |
| 9,662,381 B2 | 5/2017 | Honda et al. |
| 9,796,762 B2 | 10/2017 | Kelly et al. |
| 9,808,519 B2 | 11/2017 | Honda et al. |
| 9,839,655 B2 | 12/2017 | Mulder et al. |
| 9,855,302 B2 | 1/2018 | Gajewski et al. |
| 9,937,211 B2 | 4/2018 | Kelly et al. |
| 9,974,815 B2 | 5/2018 | Mulder et al. |
| 9,987,311 B2 | 6/2018 | Mulder et al. |
| 10,046,015 B2 | 8/2018 | Mulder et al. |
| 10,058,574 B2 | 8/2018 | Grant et al. |
| 10,080,772 B2 | 9/2018 | Crouzet et al. |
| 10,086,020 B2 | 10/2018 | Bernalier-Donadille et al. |
| 10,086,021 B2 | 10/2018 | Jeffery et al. |
| 10,086,022 B2 | 10/2018 | Bernalier-Donadille et al. |
| 10,086,023 B2 | 10/2018 | Bernalier-Donadille et al. |
| 10,183,046 B2 | 1/2019 | Kelly |
| 10,226,489 B2 | 3/2019 | Patterson et al. |
| 2003/0147858 A1 | 8/2003 | Renaud et al. |
| 2004/0065304 A1 | 1/2004 | Brudnak |
| 2004/0106564 A1 | 6/2004 | Nilius et al. |
| 2006/0062774 A1 | 3/2006 | Davis et al. |
| 2006/0073161 A1 | 4/2006 | Breton |
| 2006/0115465 A1 | 6/2006 | MacFarlane et al. |
| 2007/0167423 A1 | 7/2007 | Bergauer et al. |
| 2007/0258953 A1 | 11/2007 | Duncan et al. |
| 2007/0286913 A1 | 12/2007 | Swain et al. |
| 2008/0069861 A1 | 3/2008 | Brown et al. |
| 2008/0206212 A1 | 8/2008 | McMahon et al. |
| 2008/0260906 A1 | 10/2008 | Stojanovic |
| 2008/0299098 A1 | 12/2008 | Se et al. |
| 2009/0217401 A1 | 8/2009 | Korman et al. |
| 2010/0028449 A1 | 2/2010 | Prakash et al. |
| 2010/0047209 A1 | 2/2010 | Stanton et al. |
| 2010/0247489 A1 | 9/2010 | Saur-Brosch |
| 2010/0284973 A1 | 11/2010 | Schiffer-Mannioui et al. |
| 2010/0303782 A1 | 12/2010 | Cobb et al. |
| 2010/0311686 A1 | 12/2010 | Kasper et al. |
| 2010/0316617 A1 | 12/2010 | Renaud et al. |
| 2011/0053829 A1 | 3/2011 | Baumhof et al. |
| 2011/0086011 A1 | 4/2011 | Kasper et al. |
| 2011/0280840 A1 | 11/2011 | Blaser et al. |
| 2012/0020943 A1 | 1/2012 | Lin |
| 2012/0107279 A1 | 5/2012 | Arigoni et al. |
| 2013/0022575 A1 | 1/2013 | Cassity |
| 2013/0130988 A1 | 5/2013 | Blareau et al. |
| 2013/0195802 A1 | 8/2013 | Moore |
| 2013/0280724 A1 | 10/2013 | Ramadan et al. |
| 2013/0316032 A1 | 11/2013 | Itoh et al. |
| 2013/0336931 A1 | 12/2013 | Wadstroem et al. |
| 2014/0037716 A1 | 2/2014 | Nowill et al. |
| 2014/0056852 A1 | 2/2014 | Guglielmetti et al. |
| 2014/0112897 A1 | 4/2014 | Pyne et al. |
| 2014/0147425 A1* | 5/2014 | Henn .................. A61K 35/742 424/93.41 |
| 2014/0154218 A1 | 6/2014 | Kohno et al. |
| 2014/0179770 A1 | 6/2014 | Zhang et al. |
| 2014/0193464 A1 | 7/2014 | Lin et al. |
| 2014/0199281 A1 | 7/2014 | Henn et al. |
| 2014/0227227 A1 | 8/2014 | Qin et al. |
| 2014/0328803 A1 | 11/2014 | Mckenzie et al. |
| 2014/0335131 A1 | 11/2014 | Mazmanian et al. |
| 2014/0341921 A1 | 11/2014 | Honda et al. |
| 2014/0363397 A1 | 12/2014 | Allen-Vercoe et al. |
| 2015/0044173 A1 | 2/2015 | Jones et al. |
| 2015/0071957 A1 | 3/2015 | Kelly et al. |
| 2015/0104418 A1 | 4/2015 | Flint et al. |
| 2015/0132264 A1 | 5/2015 | Kelly et al. |
| 2015/0284781 A1 | 10/2015 | Klumpp et al. |
| 2016/0058804 A1 | 3/2016 | Jones et al. |
| 2016/0067188 A1 | 3/2016 | Cade et al. |
| 2016/0184370 A1 | 6/2016 | Mckenzie et al. |
| 2016/0199424 A1 | 7/2016 | Berry et al. |
| 2016/0223553 A1 | 8/2016 | Sears et al. |
| 2016/0235792 A1 | 8/2016 | Berry et al. |
| 2017/0143772 A1 | 5/2017 | Mulder et al. |
| 2017/0143773 A1 | 5/2017 | Mulder et al. |
| 2017/0143774 A1 | 5/2017 | Mulder et al. |
| 2017/0143775 A1 | 5/2017 | Mulder et al. |
| 2017/0319634 A1 | 11/2017 | Grant et al. |
| 2017/0326202 A1 | 11/2017 | Kelly |
| 2017/0354695 A1 | 12/2017 | Grant et al. |
| 2017/0360856 A1 | 12/2017 | Grant et al. |
| 2017/0368110 A1 | 12/2017 | Grant et al. |
| 2018/0072778 A1 | 3/2018 | Kelly et al. |
| 2018/0078585 A1 | 3/2018 | Mulder et al. |
| 2018/0078587 A1 | 3/2018 | Crott et al. |
| 2018/0133265 A1 | 5/2018 | Stevenson |
| 2018/0207207 A1 | 7/2018 | Bernalier-Donadille et al. |
| 2018/0207208 A1 | 7/2018 | Jeffery et al. |
| 2018/0214496 A1 | 8/2018 | Bernalier-Donadille et al. |
| 2018/0221421 A1 | 8/2018 | Bernalier-Donadille et al. |
| 2018/0250346 A1 | 9/2018 | Mulder et al. |
| 2018/0271918 A1 | 9/2018 | Kelly et al. |
| 2018/0344780 A1 | 12/2018 | Grant et al. |
| 2018/0369292 A1 | 12/2018 | Bernalier-Donadille et al. |
| 2018/0369293 A1 | 12/2018 | Jeffery et al. |
| 2019/0000892 A1 | 1/2019 | Mulder, I et al. |
| 2019/0008908 A1 | 1/2019 | Crouzet et al. |
| 2019/0015459 A1 | 1/2019 | Grant et al. |
| 2019/0099458 A1 | 4/2019 | Grant et al. |
| 2019/0134109 A1 | 5/2019 | Mulder, I et al. |
| 2019/0151380 A1 | 5/2019 | Grant et al. |
| 2019/0247448 A1 | 8/2019 | Grant et al. |
| 2019/0255123 A1 | 8/2019 | Jeffery et al. |

FOREIGN PATENT DOCUMENTS

| | | |
|---|---|---|
| CN | 1917946 A | 2/2007 |
| CN | 1954066 A | 4/2007 |
| CN | 101590081 A | 12/2009 |
| CN | 102304483 A | 1/2012 |
| CN | 102031235 B | 7/2012 |
| CN | 102093967 B | 1/2013 |
| CN | 102905558 A | 1/2013 |
| CN | 102940652 A | 2/2013 |
| CN | 102373172 B | 3/2013 |
| CN | 103037876 A | 4/2013 |
| CN | 103142656 A | 6/2013 |
| CN | 103146620 A | 6/2013 |
| CN | 103156888 A | 6/2013 |
| CN | 103652322 A | 3/2014 |
| CN | 103781487 A | 5/2014 |
| CN | 103820363 A | 5/2014 |
| CN | 103849590 A | 6/2014 |
| CN | 103865846 A | 6/2014 |
| CN | 103930117 A | 7/2014 |
| CN | 103981115 A | 8/2014 |
| CN | 103981117 A | 8/2014 |
| CN | 104160014 A | 11/2014 |
| CN | 104195075 A | 12/2014 |
| CN | 103509741 B | 2/2015 |
| CN | 102940652 B | 3/2015 |
| CN | 104435000 A | 3/2015 |
| CN | 103037876 B | 4/2015 |
| CN | 104546932 A | 4/2015 |
| CN | 104546933 A | 4/2015 |
| CN | 104546934 A | 4/2015 |
| CN | 104546935 A | 4/2015 |
| CN | 104546940 A | 4/2015 |
| CN | 104546942 A | 4/2015 |
| CN | 104560820 A | 4/2015 |
| CN | 105112333 A | 12/2015 |
| CN | 103820363 B | 2/2016 |
| CN | 103865846 B | 3/2016 |
| CN | 105982919 A | 10/2016 |
| DE | 19826928 A1 | 12/1999 |
| DE | 10206995 A1 | 9/2003 |

(56) References Cited

FOREIGN PATENT DOCUMENTS

| | | |
|---|---|---|
| EP | 0120516 A2 | 10/1984 |
| EP | 0238023 A2 | 9/1987 |
| EP | 0433299 A1 | 6/1991 |
| EP | 0449375 A2 | 10/1991 |
| EP | 0581171 A1 | 2/1994 |
| EP | 0778778 A1 | 6/1997 |
| EP | 0888118 A1 | 1/1999 |
| EP | 1141235 A2 | 10/2001 |
| EP | 1227152 A1 | 7/2002 |
| EP | 1383514 A1 | 1/2004 |
| EP | 1448995 A1 | 8/2004 |
| EP | 1481681 A1 | 12/2004 |
| EP | 1765391 A1 | 3/2007 |
| EP | 1675481 B1 | 11/2008 |
| EP | 1997499 A1 | 12/2008 |
| EP | 1997905 A1 | 12/2008 |
| EP | 1997906 A1 | 12/2008 |
| EP | 1997907 A1 | 12/2008 |
| EP | 2044436 A2 | 4/2009 |
| EP | 2103226 A1 | 9/2009 |
| EP | 2133088 A3 | 1/2010 |
| EP | 1280541 B2 | 3/2010 |
| EP | 2236598 A1 | 10/2010 |
| EP | 2286832 A1 | 2/2011 |
| EP | 2308498 A1 | 4/2011 |
| EP | 2217253 B1 | 6/2011 |
| EP | 1940243 B1 | 8/2011 |
| EP | 2359838 A1 | 8/2011 |
| EP | 1855550 B1 | 10/2011 |
| EP | 1871400 B1 | 10/2011 |
| EP | 2124972 B1 | 6/2012 |
| EP | 1773361 B2 | 9/2012 |
| EP | 1945234 B1 | 12/2012 |
| EP | 2323493 B8 | 12/2012 |
| EP | 2323494 B8 | 12/2012 |
| EP | 1629850 B2 | 5/2013 |
| EP | 2203551 B1 | 8/2013 |
| EP | 2140771 B1 | 12/2013 |
| EP | 2687227 A1 | 1/2014 |
| EP | 2179028 B1 | 8/2014 |
| EP | 2650002 A4 | 8/2014 |
| EP | 2164349 B1 | 9/2014 |
| EP | 2134835 B1 | 10/2014 |
| EP | 2810652 A2 | 12/2014 |
| EP | 2305838 B1 | 1/2015 |
| EP | 2832859 A1 | 2/2015 |
| ES | 2408279 A2 | 6/2013 |
| JP | H08259450 A | 10/1996 |
| JP | 2003261453 A | 9/2003 |
| JP | 2005097280 A | 4/2005 |
| JP | 2006265212 A | 10/2006 |
| JP | 2007084533 A | 4/2007 |
| JP | 2007116991 A | 5/2007 |
| JP | 2008195635 A | 8/2008 |
| JP | 2009507023 A | 2/2009 |
| JP | 2010246523 A | 11/2010 |
| JP | 5031249 B2 | 9/2012 |
| JP | 2013005759 A | 1/2013 |
| JP | 5183848 B2 | 4/2013 |
| JP | 2013527240 A | 6/2013 |
| JP | 2013201912 A | 10/2013 |
| JP | 2014196260 A | 10/2014 |
| JP | 2014534957 A | 12/2014 |
| JP | 2015500792 A | 1/2015 |
| JP | 5710876 B2 | 4/2015 |
| JP | 5792105 B2 | 10/2015 |
| JP | 2017147960 A | 8/2017 |
| KR | 100468522 B1 | 1/2005 |
| KR | 20100128168 A | 12/2010 |
| KR | 1020100128168 | 12/2010 |
| KR | 101017448 B1 | 2/2011 |
| KR | 101057357 B1 | 8/2011 |
| KR | 20130021764 A | 3/2013 |
| KR | 101250463 B1 | 4/2013 |
| KR | 20140037544 A | 3/2014 |
| KR | 20140061328 A | 5/2014 |
| PL | 229020 B1 | 5/2018 |
| RU | 2078815 C1 | 5/1997 |
| TW | I417054 B | 12/2013 |
| WO | WO-8807865 A1 | 10/1988 |
| WO | WO-9117243 A1 | 11/1991 |
| WO | WO-9611014 A1 | 4/1996 |
| WO | WO-9720577 A1 | 6/1997 |
| WO | WO-9730717 A1 | 8/1997 |
| WO | WO-9735956 A1 | 10/1997 |
| WO | WO-9843081 A1 | 10/1998 |
| WO | WO-9855131 A1 | 12/1998 |
| WO | WO-9857631 A1 | 12/1998 |
| WO | WO-9919459 A1 | 4/1999 |
| WO | WO-9942568 A1 | 8/1999 |
| WO | WO-9945955 A1 | 9/1999 |
| WO | WO-0116120 A1 | 3/2001 |
| WO | WO-0158275 A2 | 8/2001 |
| WO | WO-0185187 A1 | 11/2001 |
| WO | WO-0193904 A1 | 12/2001 |
| WO | WO-0207741 A1 | 1/2002 |
| WO | WO-0242328 A2 | 5/2002 |
| WO | WO-02070670 A1 | 9/2002 |
| WO | WO-02085933 A1 | 10/2002 |
| WO | WO-02094296 A1 | 11/2002 |
| WO | WO-03010297 A1 | 2/2003 |
| WO | WO-03022255 A2 | 3/2003 |
| WO | WO-03045317 A2 | 6/2003 |
| WO | WO-03046580 A1 | 6/2003 |
| WO | WO-03053220 A2 | 7/2003 |
| WO | WO-2004003235 A3 | 6/2004 |
| WO | WO-2004085628 A1 | 10/2004 |
| WO | WO-2005007834 A1 | 1/2005 |
| WO | WO-2005030133 A2 | 4/2005 |
| WO | WO-2005032567 A2 | 4/2005 |
| WO | WO-2005058335 A1 | 6/2005 |
| WO | WO-2005032567 A3 | 7/2005 |
| WO | WO-2005093049 A1 | 10/2005 |
| WO | WO-2005107381 A2 | 11/2005 |
| WO | WO-2005121130 A2 | 12/2005 |
| WO | WO-2006012586 A2 | 2/2006 |
| WO | WO-2006033949 A1 | 3/2006 |
| WO | WO-2006033950 A1 | 3/2006 |
| WO | WO-2006033951 A1 | 3/2006 |
| WO | WO-2006102350 A1 | 9/2006 |
| WO | WO-2006102536 A2 | 9/2006 |
| WO | WO-2006091103 A3 | 10/2006 |
| WO | WO-2006110406 A2 | 10/2006 |
| WO | WO-2006130205 A1 | 12/2006 |
| WO | WO-2007027761 A2 | 3/2007 |
| WO | WO-2007056218 A2 | 5/2007 |
| WO | WO-2007064732 A1 | 6/2007 |
| WO | WO-2007064749 A1 | 6/2007 |
| WO | WO-2007098371 A2 | 8/2007 |
| WO | WO-2007136719 A2 | 11/2007 |
| WO | WO-2007140230 A3 | 2/2008 |
| WO | WO-2008031438 A3 | 5/2008 |
| WO | WO-2008055702 A1 | 5/2008 |
| WO | WO-2008055703 A2 | 5/2008 |
| WO | WO-2008064489 A1 | 6/2008 |
| WO | WO-2008073148 A2 | 6/2008 |
| WO | WO-2008076696 A2 | 6/2008 |
| WO | WO-2008053444 A3 | 7/2008 |
| WO | WO-2008083157 A2 | 7/2008 |
| WO | WO-2008134450 A2 | 11/2008 |
| WO | WO-2008153377 A1 | 12/2008 |
| WO | WO-2009027753 A1 | 3/2009 |
| WO | WO-2009030481 A1 | 3/2009 |
| WO | WO-2009055362 A1 | 4/2009 |
| WO | WO-2009059284 A2 | 5/2009 |
| WO | WO-2009072889 A1 | 6/2009 |
| WO | WO-2009079564 A2 | 6/2009 |
| WO | WO-2009043856 A3 | 7/2009 |
| WO | WO-2009080862 A1 | 7/2009 |
| WO | WO-2009100331 A2 | 8/2009 |
| WO | WO-2009116864 A1 | 9/2009 |
| WO | WO-2009128949 A2 | 10/2009 |
| WO | WO-2009138220 A1 | 11/2009 |
| WO | WO-2009149149 A1 | 12/2009 |

(56) References Cited

FOREIGN PATENT DOCUMENTS

| | | |
|---|---|---|
| WO | WO-2009151315 A1 | 12/2009 |
| WO | WO-2009154463 A2 | 12/2009 |
| WO | WO-2009156301 A1 | 12/2009 |
| WO | WO-2010002241 A1 | 1/2010 |
| WO | WO-2010036876 A2 | 4/2010 |
| WO | WO-2010037402 A1 | 4/2010 |
| WO | WO-2010037408 A1 | 4/2010 |
| WO | WO-2010037539 A1 | 4/2010 |
| WO | WO-2010048481 A1 | 4/2010 |
| WO | WO-2010063601 A1 | 6/2010 |
| WO | WO-2010081126 A3 | 9/2010 |
| WO | WO-2010129839 A1 | 11/2010 |
| WO | WO-2010130659 A1 | 11/2010 |
| WO | WO-2010130660 A1 | 11/2010 |
| WO | WO-2010130662 A1 | 11/2010 |
| WO | WO-2010130663 A1 | 11/2010 |
| WO | WO-2010130697 A1 | 11/2010 |
| WO | WO-2010130699 A1 | 11/2010 |
| WO | WO-2010130700 A1 | 11/2010 |
| WO | WO-2010130701 A1 | 11/2010 |
| WO | WO-2010130702 A1 | 11/2010 |
| WO | WO-2010130704 A1 | 11/2010 |
| WO | WO-2010130710 A1 | 11/2010 |
| WO | WO-2010130713 A1 | 11/2010 |
| WO | WO-2010/143940 A1 | 12/2010 |
| WO | WO-2010139531 A1 | 12/2010 |
| WO | WO-2010142504 A1 | 12/2010 |
| WO | WO-2010143961 A1 | 12/2010 |
| WO | WO-2010147714 A1 | 12/2010 |
| WO | WO-2010133475 A3 | 1/2011 |
| WO | WO-2011000620 A1 | 1/2011 |
| WO | WO-2011000621 A1 | 1/2011 |
| WO | WO-2011005756 A1 | 1/2011 |
| WO | WO-2010133472 A3 | 2/2011 |
| WO | WO-2011020748 A1 | 2/2011 |
| WO | WO-2011036539 A1 | 3/2011 |
| WO | WO-2011043654 A1 | 4/2011 |
| WO | WO-2011044208 A1 | 4/2011 |
| WO | WO-2011058535 A1 | 5/2011 |
| WO | WO-2011075138 A1 | 6/2011 |
| WO | WO-2011096808 A1 | 8/2011 |
| WO | WO-2011096809 A1 | 8/2011 |
| WO | WO-2011110918 A1 | 9/2011 |
| WO | WO-2011121379 A1 | 10/2011 |
| WO | WO-2011149335 A1 | 12/2011 |
| WO | WO-2011152566 A2 | 12/2011 |
| WO | WO-2011153226 A2 | 12/2011 |
| WO | WO-2011157816 A1 | 12/2011 |
| WO | WO-2012012874 A1 | 2/2012 |
| WO | WO-2012016287 A2 | 2/2012 |
| WO | WO-2012024638 A2 | 2/2012 |
| WO | WO-2011153226 A3 | 3/2012 |
| WO | WO-2012055408 A1 | 5/2012 |
| WO | WO-2012062780 A1 | 5/2012 |
| WO | WO-2012071380 A1 | 5/2012 |
| WO | WO-2012076739 A1 | 6/2012 |
| WO | WO-2012105312 A1 | 8/2012 |
| WO | WO-2012122478 A1 | 9/2012 |
| WO | WO-2012140636 A1 | 10/2012 |
| WO | WO-2012142605 A1 | 10/2012 |
| WO | WO-2012145491 A2 | 10/2012 |
| WO | WO-2012158517 A1 | 11/2012 |
| WO | WO-2012165843 A2 | 12/2012 |
| WO | WO-2012170478 A2 | 12/2012 |
| WO | WO-2013005836 A1 | 1/2013 |
| WO | WO-2013008039 A2 | 1/2013 |
| WO | WO-2013008102 A2 | 1/2013 |
| WO | WO-2013037068 A1 * | 3/2013 ................ A61P 1/12 |
| WO | WO-2013050792 A1 | 4/2013 |
| WO | WO-2013053836 A1 | 4/2013 |
| WO | WO-2013063849 A1 | 5/2013 |
| WO | WO-2013080561 A1 | 6/2013 |
| WO | WO-2013124725 A1 | 8/2013 |
| WO | WO-2013144701 A1 | 10/2013 |
| WO | WO-2013153358 A1 | 10/2013 |
| WO | WO-2013154725 A1 | 10/2013 |
| WO | WO-2013171515 A1 | 11/2013 |
| WO | WO-2013175038 A1 | 11/2013 |
| WO | WO-2013181694 A1 | 12/2013 |
| WO | WO-2013182038 A1 | 12/2013 |
| WO | WO-2014001368 A1 | 1/2014 |
| WO | WO-2014019271 A1 | 2/2014 |
| WO | WO-2014020004 A1 | 2/2014 |
| WO | WO-2014032108 A1 | 3/2014 |
| WO | WO-2014036182 A2 | 3/2014 |
| WO | WO-2014043593 A2 | 3/2014 |
| WO | WO-2014053608 A1 | 4/2014 |
| WO | WO-2014064359 A1 | 5/2014 |
| WO | WO-2014067976 A1 | 5/2014 |
| WO | WO-2014070014 A1 | 5/2014 |
| WO | WO-2014070225 A1 | 5/2014 |
| WO | WO-2014075745 A1 | 5/2014 |
| WO | WO-2014078911 A1 | 5/2014 |
| WO | WO-2014082050 A1 | 5/2014 |
| WO | WO-2014093622 A2 | 6/2014 |
| WO | WO-2014093635 A1 | 6/2014 |
| WO | WO-2014093655 A2 | 6/2014 |
| WO | WO-2014121298 A2 | 8/2014 |
| WO | WO-2014121301 A1 | 8/2014 |
| WO | WO-2014121302 A2 | 8/2014 |
| WO | WO-2014121304 A1 | 8/2014 |
| WO | WO-2014130540 A1 | 8/2014 |
| WO | WO-2014137211 A1 | 9/2014 |
| WO | WO-2014145958 A2 | 9/2014 |
| WO | WO-2014150094 A1 | 9/2014 |
| WO | WO-2014152338 A1 | 9/2014 |
| WO | WO-2014153194 A2 | 9/2014 |
| WO | WO-2014121302 A3 | 10/2014 |
| WO | WO-2014167338 A1 | 10/2014 |
| WO | WO-2014182966 A1 | 11/2014 |
| WO | WO-2014200334 A1 | 12/2014 |
| WO | WO-2014201037 A2 | 12/2014 |
| WO | WO-2015003001 A1 | 1/2015 |
| WO | WO-2015006355 A2 | 1/2015 |
| WO | WO-2015013214 A2 | 1/2015 |
| WO | WO-2015017625 A1 | 2/2015 |
| WO | WO-2015021936 A1 | 2/2015 |
| WO | WO-201503305 A1 | 3/2015 |
| WO | WO-2015038731 A1 | 3/2015 |
| WO | WO-2015057151 A1 | 4/2015 |
| WO | WO-2015077794 A1 | 5/2015 |
| WO | WO-2015095241 A2 | 6/2015 |
| WO | WO-2015077794 A4 | 7/2015 |
| WO | WO-2015156419 A1 | 10/2015 |
| WO | WO-2015156519 A1 | 10/2015 |
| WO | WO-2015168534 A1 | 11/2015 |
| WO | WO-2015169944 A1 | 11/2015 |
| WO | WO-2015095241 A4 | 12/2015 |
| WO | WO-2016019506 A1 | 2/2016 |
| WO | WO-2016030504 A1 | 3/2016 |
| WO | WO-2016033439 A2 | 3/2016 |
| WO | WO-2016036615 A1 | 3/2016 |
| WO | WO-2016057671 A1 | 4/2016 |
| WO | WO-2016065324 A1 | 4/2016 |
| WO | WO-2016069795 A2 | 5/2016 |
| WO | WO-2016069801 A1 | 5/2016 |
| WO | WO-2016070151 A1 | 5/2016 |
| WO | WO-2016086161 A1 | 6/2016 |
| WO | WO-2016086205 A2 | 6/2016 |
| WO | WO-2016086206 A1 | 6/2016 |
| WO | WO-2016086208 A1 | 6/2016 |
| WO | WO-2016086209 A1 | 6/2016 |
| WO | WO-2016086210 A1 | 6/2016 |
| WO | WO-2016102950 A1 | 6/2016 |
| WO | WO-2016102951 A1 | 6/2016 |
| WO | WO-2016118730 A1 | 7/2016 |
| WO | WO-2016139217 A1 | 9/2016 |
| WO | WO-2016149449 A1 | 9/2016 |
| WO | WO-2016149687 A1 | 9/2016 |
| WO | WO-2016203218 A1 | 12/2016 |
| WO | WO-2016203220 A1 | 12/2016 |
| WO | WO-2017085520 A1 | 5/2017 |
| WO | WO-2017091753 A1 | 6/2017 |
| WO | WO-2017148596 A1 | 9/2017 |

(56) References Cited

FOREIGN PATENT DOCUMENTS

| | | |
|---|---|---|
| WO | WO-2017160711 A1 | 9/2017 |
| WO | WO-2018011594 A1 | 1/2018 |
| WO | WO-2018/112365 A2 | 6/2018 |
| WO | WO-2018112363 | 6/2018 |
| WO | WO-2018112363 A1 | 6/2018 |
| WO | WO-2018112365 A2 | 6/2018 |
| WO | WO-2018215782 A1 | 11/2018 |
| WO | WO-2019010255 A1 | 1/2019 |

OTHER PUBLICATIONS

Jan. 17, 2019 Notice of Allowance for U.S. Appl. No. 15/803,721.
Jan. 30, 2019 Notice of Corrected Allowability for U.S. Appl. No. 15/803,721.
Jan. 30, 2019 Final Rejection for U.S. Appl. No. 15/842,635.
Dec. 21, 2018 Notice of Allowance U.S. Appl. No. 15/700,700.
Feb. 1, 2019 Non-Final Office Action U.S. Appl. No. 16/040,356.
Mar. 4, 2019 Final Office Action for U.S. Appl. No. 15/704,245.
4d Pharma Plc: "Clinical Update—RNS—London Stock Exchange", Jul. 19, 2016.
4D Pharma:"4Dpharma PLC clinical update on blautix (TM), a novel treatment to irritable bowel syndrome," 4DPharma, Jan. 19, 2016, XP002769874, Retrieved from: https://www.directorstalkinterviews.com/4d-pharma-plc-clinical-update-on-blautix-a-novel-treatment-for-irritable-bowel-syndrome/412689588. [Retrieved on May 5, 2017].
Ahanchian, Hamic, A multi-strain synbiotic may reduce viral respiratory infections in asthmatic children: a randomized controlled trial; Sep. 2016, vol. 8, Issue 9, pp. 2833-2839, DOI: http://dxdoi.or/10.19082/2833.
Alp, G., and Aslim, B. (2010). Relationship between the resistance to bile salts and low pH with exopolysaccharide (EPS) production of *Bifidobacterium* spp. isolated from infants feces and breast milk. Anaerobe 16(2), 101-105. doi: 10.1016/j.anaerobe.2009.06.006.
Altschul et al. 'Basic local alignment search tool.' Journal of Molecular Biology. 1990, vol. 215, No. 3, pp. 403-410.
Álvarez-Martin, P., O'Connell-Motherway, M., van Sinderen, D., and Mayo, B. (2007). Functional analysis of the pBC1 replicon from Bifidobacterium catenulatum L48. Applied Microbiology and Biotechnology 76(6), 1395. doi: 10.1007/s00253-007-1115-5.
Aminov et al. Molecular diversity, cultivation, and improved detection by fluorescent in situ hybridization of a dominant group of human gut bacteria related to *Roseburia* spp. or Eubacterium rectale. Applied and environmental microbiology. 2006, vol. 72, No. 9, pp. 6371-6376.
An et al. (1985) "New cloning vehicles for transformation of higher plants," EMBO J. 4:277-284.
An et al. (1988) "Binary Vectors," Plant Molecular Biology Manual. A3:1-19.
An et al. Transformation of Tobacco, Tomato, Potato, and *Arabiodopsis thaliana* Using a Binary Ti Vector System,Plant Physiol. May 1986; 81:301-305.
Anonymous: "4D pharma's Blautix for Irritable Bowel Syndrome shows positive impact—pharmaceutical daily news", Dec. 13, 2016.
Appleyard, Caroline B. et al., Pretreatment with the probiotic VSL#3 delays transition from inflammation to dysplasia in rate model of colitis-associated cancer; Am J. Physiol. Gastrointest. Liver Physiol. 301:G1004-G1013, 2011, Sep. 8, 2011:DOI:10.1152.ajpg.00167.2011.
Archer et al. (1997) "The Molecular Biology of Secreted Enzyme Production by Fungi," Critical Reviews Biotechnology. 17(4):273-306.
Arenberg, et al., Interferon-y-induoible Protein 10 (IP-10) Is an Angiostatic Factor That Inhibits Human Non-small Cell Lung Cancer (NSCLC) Tumorigenesis and Spontaneous Metastases. 1996. J. Exp.Med. 184:981-92.
Atarashi et al. Induction of colonic regulatory T cells by indigenous *Clostridium* species. Science 331(6015):337-341 (2011).
Atarashi et al., Th17 Cell Induction by Adhesion of Microbes to Intestinal Epithelial Cells. Cell, vol. 163, No. 2, Oct. 8, 2015. pp. 367-380.
Atarashi, et al., Treg induction by a rationally selected mixture of Clostridia strains from the human microbiota. Supplementary Information. Nature 500, 232-236 (Aug. 8, 2013) doi:10.1038/nature12331.
Atarashi, K. et al., Treg induction by a rationally selected mixture of Clostridia strains from the human microbiota. Nature. 2013; 500(7461):232-236.
ATCC Catalog, https://www.atcc.org/search_results.aspx?dsNav=Ntk:primarysearch%7cbacteroides+thetaiotaomicron%7c3%7c,Ny:true,ro:0,N:1000552&searchterms=bacteroides+thetaiotaomicron&redir=1, Accessed on May 2, 2018.
Ausubel et al. (1999) Short Protocols in Molecular Biology. 4th edition, pp. 7-58 to 7-60, and Chapter 18. pp. 18-1 to 18-23.
Awadel-Kariem, Mustafa et al., First report of Parabacteroides goldsteinii bacteraemia in a patient with complicated intra-abdominal infection, Anaerobe, vol. 16, Issue 3, Jun. 2010, pp. 223-225.
Azad, M.B. et al., Probiotic supplementation during pregnancy or infancy for the prevention of asthma and wheeze: systematic review and meta-analysis BMJ 2013; 347 :f6471.
Aziz et al. The RAST Server: rapid annotations using subsystems technology. BMC Genomics. 2008, vol. 9, No. 1, pp. 75.
Aziz, R.K., Bartels, D., Best, A.A., DeJongh, M., Disz, T., Edwards, R.A., et al. (2008). The RAST Server: Rapid Annotations using Subsystems Technology. BMC Genomics 9, 75. doi: 10.1186/1471-2164-9-75.
Bagge, et al., Diversity of spore-forming bacteria in cattle manure, slaughterhouse waste and samples from biogas plants. Journal of applied microbiology. 2010;109: 1549-1565.
Balato, et al., Effects of adalimumab therapy in adult subjects with moderate-to-severe psoriasis on Th17 pathway. (2014) J Eur Acad Dermatol Venereol. 28(8):1016-24.
Banfield, J. & Murphy, K.R., Non-Th2, Late-onset, non-allergic asthma. Copd & Asthma for NPs, A peer-reviewed newsletter, Aug. 2016; 14: 8 Pages.
Barcenilla et al. "Phylogenetic relationships of butyrate-producing bacteria from the human gut" Applied and environmental microbiology. 2000, vol. 66, No. 4, pp. 1654-1661.
Barry, et al., Criteria for Disksusceptibility tests and quality control guidelines for the cefoperazone-sulbactam combination, Journal of clinical microbiology, Jan. 1988;26(1):13-17.
Beaucage, et al. Deoxynucleoside phosphoramidites—A new class of key intermediates for deoxypolynucleotide synthesis. Tetrahedron Letters, vol. 22, 1981, pp. 1859-1869.
Beggs (1978) "Transformation of yeast by a replicating hybrid plasmid," Nature. 275:104-109.
Begley, M., Hill, C., and Gahan, C.G.M. (2006). Bile Salt Hydrolase Activity in Probiotics. Applied and Environmental Microbiology 72(3), 1729-1738. doi: 10.1128/AEM.72.3.1729-1738.2006.
Berg et al. (1996) "Enterocolitis and colon cancer in interleukin-10-deficient mice are associated with aberrant cytokine production and CD4(+) TH1-like responses," The Journal of Clinical Investigation. 98(4):1010-1020.
Berger, B., Moine, D., Mansourian, R., and Arigoni, F. (2010). HspR Mutations Are Naturally Selected in Bifidobacterium longum When Successive Heat Shock Treatments Are Applied. Journal of Bacteriology 192(1), 256-263. doi: 10.1128/jb.01147-09.
Berger, S. Gideon guide to medically important bacteria. Gideon E-book Series. 2017 edition. 4 pages.
Bergonzelli, G.E., Granato, D., Pridmore, R.D., Marvin-Guy, L.F., Donnicola, D., and Corthesy-Theulaz, I.E. (2006). GroEL of Lactobacillus johnsonii La1 (NCC 533) is cell surface associated: potential role in interactions with the host and the gastric pathogen Helicobacter pylori. Infect Immun 74(1), 425-434. doi: 10.1128/IAI.74.1.425-434.2006.
Bernalier et al. *Ruminococcus hydrogenotrophicus* sp. nov., a new H2/CO2-utilizing acetogenic bacterium isolated from human feces. 1996 Arch. Microbiol. 166 (3), 176-183.

(56) References Cited

OTHER PUBLICATIONS

Bernalier et al., "Acetogenesis from H02 and C0-2 By Methane and Non-Methane-Producing Human Colonic Bacterial Communities" Fems Microbiology Ecology, vol. 19. No. 3. 1996. pp. 193-202. XP000979130.

Bernalier, A., et al., "Diversity of H2/C02-utilizing acetogenic Bacteria from Feces of Non-Methane-Producing Humans", Current Microbiology vol. 33 (Aug. 1996), pp. 94-99, Springer-Vertag New York Inc., USA.

Bertram, J. et al. Establishment of a cloned line of Lewis lung carcinoma cells adapted to cell culture. (1980) Cancer let. 11:63-73.

Blandino, G., Fazio, D., DiMarco, R. Probiotics: Overview of microbiological and immunological characteristics (2008). Expert Review of Anti-Infective Therapy, 6 (4), pp. 497-508.

Bond, John H., Jr., et al., "Factors Influencing Pulmonary Medicine Excretion in Man: An indirect method of studying the in situ metabolism of the methane-producing colonic bacteria"; Journal of Experimental Medicine, Oct. 29, 1970, pp. 572-388.

Born, P., et al., "Fecal bacterial activity in symptomatic carbohydrate malabsorption: Effect on the fecal short-chain fatty acid ratio", intervention during the week "Digestive Diseases Week" from May 16 to May 19, 1999, Orlando, Z. Gasteroenterol2000: 38:623-626, Georg Thieme Verlag Stuttgart, New York, USA.

Born, P., et al., English Abstract "Carbohydrate substitutes: comparative study of intestinal absorption of fructose, sorbitol and xylitol", "Zuckeraustauschstoffe: Vergleichende Untersuchung zur intestinalen Resorption von Fructose, Sorbit und Xylit", Medizinische Klinik 89, Technischen Universitat Munchen (Munich) Nov. 15, 1994; 89 (11): 575-8 (Article in German), Urban & Vogel, Munich, Germany.

Bottacini, et al., Comparative genomics of the Bifidobacterium brevetaxon. BMC Genomics, 2014; 15:170. DOI:10.1186/1471-1471-2164-15-170.

Bottacini, F., Morrissey, R., Esteban-Torres, M., James, K., van Breen, J., Dikareva, E., et al. (2018). Comparative genomics and genotype-phenotype associations in Bifidobacterium breve. Scientific Reports 8(1), 10633. doi: 10.1038/S41598-018-28919-4.

Bottacini, F., O'Connell Motherway, M., Kuczynski, J., O'Connell, K.J., Serafini, F., Duranti, S., et al. (2014). Comparative genomics of the Bifidobacterium breve taxon. BMC Genomics 15(1), 170. doi: 10.1186/1471-2164-15-170.

Bourassa, Megan W et al. "Butyrate, neuroepigenetics and the gut microbiome: Can a high fiber diet improve brain health?." Neuroscience letters vol. 625 (2016): 56-63. doi:10.1016/j.neulet.2016.02.009.

Brand et al., Collagen-induced arthritis, 2007; Protocol 2(5):1269-1275.

Brasel et al. (2000) "Generation of murine dendritic cells from ftl3-ligand-supplemented bone marrow cultures," Blood. 96(9):3029-3039.

Bravo, Javier A. et al., "Ingestion of Lactobacillus strain regulates emotional behavior and central GABA receptor expression in a mouse via the vagus nerve", PNAS Sep. 20, 2011 108 (38) 16050-16055; https://doi.org/10.1073/pnas.1102999108.

Bressa, et al., Differences in gut microbiota profile between women with active lifestyle and sedentary women. Plos One, 2017; 12(2): 1-20.

Brook, I., Clinical Review: Bacteremia caused by anaerobic bacteria in children. Critical Care 6(3): 7 pages (2002).

Bry et al. A model of host-microbial interactions in an open mammalian ecosystem. Science 273(5280):1380-1383 (1996).

Buffie et al., Precision microbiome restoration of bile acid-mediated resistance to Clostridium difficile. Nature, 517(7533):205-208 (2015).

Busing, K. et al., Effects of oral Enterococcus faecium strain DSM 10663 NCIMB 10415 on diarrhoea patterns and performance of sucking piglets. Benef Microbes. Mar. 2015;6(1):41-4. doi: 10.3920/BM2014.0008.

Butcher et al. (1980) The role of tissue culture in the study of crown-gall tumorigenesis. Tissue Culture Methods for Plant Pathologists. Eds.: Ingrams, D. S.; Helgeson, J.P. pp. 203-208.

Candela et al. 'Interaction of probiotic Lactobacillus and Bifidobacterium strains with human intestinal epithelial cells:Adhesion properties, competition against enteropathogens and modulation of IL-8 production'. International Journal of Food Microbiology. 2008, vol. 125, No. 3, pp. 286-292.

Candela, M., Bergmann, S., Vici, M., Vitali, B., Turroni, S., Eikmanns, B.J., et al. (2007). Binding of human plasminogen to Bifidobacterium. J Bacteriol 189(16), 5929-5936. doi: 10.1128/JB.00159-07.

Candela, M., Biagi, E., Centanni, M., Turroni, S., Vici, M., Musiani, F., et al. (2009). Bifidobacterial enolase, a cell surface receptor for human plasminogen involved in the interaction with the host. Microbiology 155(Pt 10), 3294-3303. doi: 10.1099/mic.0.028795-0.

Candela, M., Centanni M Fau—Fiori, J., Fiori J Fau—Biagi, E., Biagi E Fau—Turroni, S., Turroni S Fau—Orrico, C., Orrico C Fau—Bergmann, S., et al. (2010). DnaK from *Bifidobacterium animalis* subsp. *lactis* is a surface-exposed human plasminogen receptor upregulated in response to bile salts. Microbiology 156(6), 1609-1618.

Caruthers, et al. New chemical methods for synthesizing polynucleotides. Nucleic Acids Symp Ser. 1980;(7):215-23.

Carvalho et al. (Jan. 2011) "TLR5 activation induces secretory interleukin-1 receptor antagonist (sII-1 Ra) and reduces inftammasome-associated tissue damage," Nature. 4(1 ):102-111.

Casey et al. 'Isolation and characterization of anti-*Salmonella* lactic acid bacteria from the porcine gastrointestinal tract'. Letters in Applied Microbiology. 2004, vol. 39, No. 5, pp. 431-438.

Caspi, P.R. Experimental autoimmune uveoretinitis in the rat and mouse. Curr Protoc Immunol. May 2003;Chapter 15:Unit 15.6. doi: 10.1002/0471142735.im1506s53.

Cekanaviciute, et al., Gut bacteria from multiple sclerosis patients modulate human T cells and exacerbate symptoms in mouse models. PNAS. Jun. 30, 2017; 1-6.

Cereghino et al. (2000) "Heterologous protein expression in the methylotrophic yeast *Pichia pastoris*," FEMS Microbiol Review. 24(1 ):45-66.

Charriot, et al., Future treatment for ashtma, Eur Respir Rev 2016; 25: 77-92.

Cheluvappa, R. et al., T helper type 17 pathway suppression by appendicitis and appendectomy protects against colitis. Clin Exp Immunol. Feb. 2014;175(2):316-22. doi: 10.1111/cei.12237.

Chen, S. et al., Live combined bacillus subtilis and enterococcus faecium ameliorate murine experimental colitis by immunosuppression. International journal of inflammation. 2014(878054). 7 Pages.

Chevreux et al. 'Genome sequence assembly using trace signals and additional sequence information.' German Conference on Bioinformatics. 1999.

Chi, W. et al. Upregulated IL-23 and IL-17 in Behet patients with active uveitis. Invest Ophthalmol Vis Sci. Jul. 2008;49(7):3058-64. doi: 10.1167/iovs.07-1390.

Chi, W. et al., IL-23 promotes CD4+ T cells to produce IL-17 in Vogt-Koyanagi-Harada disease. J Allergy Clin Immunol. May 2007;119(5): 1218-24. Epub Mar. 1, 2007.

Chiu, et al., Monocolonization of germ-free mice with bacteroides fragilis protects against dectran sulfate sodium-induced acute colitis. Biomed Research International 2014. vol. 2014. Article ID 675786. 9 Pages.

Choji Kaneuchi et al., "*Clostridium coccoides*, a New Species from the Feces of Mice", International Journal of Systematic Bacteriology, vol. 26, No. 4, Oct. 1976, p. 482-486.

Chothia et al. The relation between the divergence of sequence and structure in proteins. EMBO Journal. 1986, 5(4):823-826.

Christiaen, S.E., O'Connell Motherway, M., Bottacini, F., Lanigan, N., Casey, P.G., Huys, G., et al. (2014). Autoinducer-2 plays a crucial role in gut colonization and probiotic functionality of Bifidobacterium breve UCC2003. PLoSOne 9(5), e98111. doi: 10.1371/journal.pone.0098111.

Christmann, et al., Human seroreactivity to gut microbiota antigens. J Allergy Clin Immunol 136(5):1378-1386; available online May 23, 2015.

Christou (1994) "Genetic engineering of crop legumes and cereals: current status and recent advances," Agro-Food Industry Hi-Tech. pp. 17-27.

(56) References Cited

OTHER PUBLICATIONS

Chung et al. 'Microbiota-stimulated immune mechanisms to maintain gut homeostasis.' Current Opinion in Immunology. 2010, vol. 22, No. 4, pp. 455-460.
Cintas LM, Casaus MP, Herranz C, Nes IF, Hernandez PE. Review: bacteriocins of lactic acid bacteria (2001). Food Sci Technol 7(4):281-305.
Claesson, et al. Gut microbiota composition correlates with diet and health in the elderly. 2012. Nature, 488, 178-184.
Clarridge III, J.E. Impact of 16S rRNA gene sequence analysis for identification of bacteria on clinical microbiology and infectious diseases (2004). Clinical Microbiology Reviews, 17 (4), pp. 840-862.
Clinical Trials for Thetanix, EU Clinical Trials Register, Date of commencement of clinical trial: Oct. 16, 2015. Available at: https://clinicaltrialsregister.eu/ctr-search/search?query=Thetanix.
Coakley M et al.: Intestinal bifidobacteria that produce trans-9, trans-11 conjugated linoleicacid: A fatty acid with antiproliferative activity against human colon SW480and HT-29 cancer cells, Nutrition and Cancer, Taylor & Francis Group, US vol. 56, No. 1, Jan. 1, 2006 (Jan. 1, 2006), pp. 95-102, XP008087265, ISSN: 0163-5581, DOI:10.1207/515327914NC5601 13 cf. abstract, p. 101, last para. of the right-hand col.
Colin, et al., GIC-1001, a Clinical Stage, Orally Administered Colonic Analgesic Drug Proposed as a Cost-Effective Alternative To I.V. Sedation Used in Colonoscopy. Canadian Digestive Diseases Week, 2014; 2 pages.
Collins, M.D., et al., Enterococcus avium nom. rev., comb, nov.; E. casseliflavus nom. rev., comb, nov.; E. durans nom. rev., comb, nov.; E. gallinarum comb, nov.; and E. malodoratus sp. nov. (1984) Int J Syst Evol Microbiol. 34: 220-223.
Constantinescu et al. Experimental autoimmune encephalomyelitis (EAE) as a model for multiple sclerosis (MS). 2011. Br J Pharmacol. 164(4): 1079-1106.
Co-pending U.S. Appl. No. 15/359,144, filed Nov. 22, 2016.
Co-pending U.S. Appl. No. 15/916,205, filed Mar. 8, 2018.
Co-pending U.S. Appl. No. 16/206,250, filed Nov. 30, 2018.
Co-pending U.S. Appl. No. 16/240,644, filed Jan. 4, 2019.
Co-pending U.S. Appl. No. 16/247,834, filed Jan. 15, 2019.
Cotter, P.O., Hill, C., Ross, R.P. Food microbiology: Bacteriocins: Developing imlate immunity for food (2005). Nature Reviews Microbiology, 3 (10), pp. 777-788.
Crellin et al. (2005) "Human CD4+ T cells express TLR5 and its ligand ftagellin enhances the suppressive capacity and expression of FOXP3 in CD4+CD25+ T regulatory cells," Journal of Immunology. 175(12):8051-8059.
Cronin, M., Knobel, M., O'Connell-Motherway, M., Fitzgerald, G.F., and van Sinderen, D. (2007). Molecular Dissection of a Bifidobacterial Replicon. Applied and Environmental Microbiology 73(24), 7858-7866.
Cryan JF and Mombereau C.," In search of a depressed mouse: utility of models for studying depression-related behavior in genetically modified mice", Mol Psychiatry. Apr. 2004;9(4):326-57.
Cryan, John F, and Timothy G Dinan. "More than a gut feeling: the microbiota regulates neurodevelopment and behavior." Neuropsychopharmacology : official publication of the American College of Neuropsychopharmacology vol. 40,1 (2015): 241-2. doi:10.1038/npp.2014.224.
Cummings, M., Breitling, R., and Takano, E. (2014). Steps towards the synthetic biology of polyketide biosynthesis. Fems Microbiology Letters 351(2), 116-125. doi: 10.1111/1574-6968.12365.
Dahya V. et al., Clostridium ramosum Osteomyelitis in an immunocompetent patient after traumatic injury, Infectious Diseases in Clinical Practice Mar. 12, 2015 Lippincott Williams and Wilkins USA, vol. 23, No. 2, Mar. 12, 2015, pp. 102-104, XP009193312, ISSN: 1056-9103 the whole document.
Daniel Garrido et al., "Utilization of galactooligosaccharides by Bifidobacterium longum subsp. infantis isolates", Food Microbiology, 33 (2013) 262-270.

Darfeuille-Michaud et al. High prevalence of adherent-invasive Escherichia coli associated with ileal mucosa in Crohn's disease. 2004. Gastroenterology 127(2):412-21.
Darlington, G.J., Liver Cell Lines. (1987) Meth Enzymol. 151:19-38.
Database UniProt [Online] Jun. 1, 2003 (Jun. 1, 2003), "subname:Full= possible pirin family protein {ECO:0000313|EMBL:AAO75294. 1};", XP00275366,retrieved from EBI accession No. UNIPROT:Q8ABC3 Database accession No. Q8ABC3.
Database WPI, Week 201801, Thomson Scientific, London, GB; AN 2017-834299, XP002787097, & WO 2017/209156 Al (Morinaga Milk Ind Co. LTD) Dec. 7, 2017 (Dec. 7, 2017) * abstract * of W02017/2019156, Kobayashi, Youdai et al.
DATABASE WPI,Week 201801, Thomson Scientific, London, GB; AN 2017-834299, XP002787097,& WO 2017/209156 Al (Morinaga Milk Ind Co Ltd) Dec. 7, 2017 (Dec. 7, 2017) * abstract *.
Davis et al. (1971) "Genetic and Microbiological Research Technqiues," Methods Enzymol. 17A:79-143.
Davis et al., Genetic and Microbiological Research Techniques, Methods Enzymol. 1970; 17A:79-143.
De Paepe et al. 'Trade-off between bile resistance and nutritional competence drives Escherichia coli diversification in the mouse gut.' PLoS Genetics. 2011, vol. 7, No. 6, e1002107.
De Ruyter, P.G., Kuipers, O.P., and de Vos, W.M. (1996). Controlled gene expression systems for Lactococcus lactis with the food-grade inducer nisin. Applied and Environmental Microbiology 62(10), 3662-3667.
Deangelis, M., et al., Selection of potential probiotic lactobacilli from pig feces to be used as additives in pelleted feeding (2006). Research in Microbiology, 157 (8), pp. 792-801.
Delgado, S., Ruiz, L., Hevia, A., Ruas-Madiedo, P., Margolles, A., and Sánchez, B. (2018). "Evidence of the In Vitro and In Vivo Immunological Relevance of Bifidobacteria," in The Bifidobacteria and Related Organisms.), 295-305.
Demarche, et al., Detailed analysis of sputum and systemic inflammation in asthma phenotypes: are paucigranulocytic asthmatics really non-inflammatory?, BMC Pulmonary Medicine, 2016; (16)46:1-13.
Dennis et al. 'DAVID: database for annotation, visualization, and integrated discovery.' Genome Bioi. 2003, vol. 4, No. 5, p. 3.
Dheeraj Mohania et al., "Modulation of expression of Programmed Death-1 by administration of probiotic Dahi in DMH-induced colorectal carcinogenesis in rats", Acta Biomed 2013; 84: 102-109.
Distrutti, et al., 5-Amino-2-hydroxybenzoic Acid 4-(5-Thioxo-5H-[1,2]dithiol-3yl)-phenyl Ester (ATB-429), a Hydrogen Sulfide-Releasing Derivative of Mesalamine, Exerts Antinociceptive Effects in a Model of Postinflammatory Hypersensitivity. The Journal of pharmacology and experimental therapeutics, 2006;319(1):447-458.
Distrutti, et al., Gut Microbiota role in irritable bowel syndrome: New therapeutic strategies. World Journal of Gastroenterology. Feb. 21, 2016; 22(7): p. 2219-2241, XP002769875.
Distrutti, et al., Hydrogen sulphide induces u opioid receptor-dependent analgesia in a rodent model of visceral pain. Molecular Pain, 2010; 6(36):1-16.
Divyashri et al. Probiotic attributes, antioxidant, anti-inflammatory and neuromodulatory effects of Enterococcus faecium CFR 3003: in vitro and in vivo evidence. (2015) J Med Microbiol, doi: 10.1099/ jmm.0.000184.
DMSZ: Opening of Ampoules and Rehydration of Dried Cultures; (http://web.archive.org/web/20000 52411541 O/www.dsmz.de/ open. htm); updated of website on Mar. 2000.
Dong, H., Rowland I Fau—Yaqoob, P., and Yaqoob, P. (2012). Comparative effects of six probiotic strains on immune function in vilro. Br J Nutr 108(3), 459-470. doi: 10.1017/S0007114511005824.
Dong-Hyun Kim and Young-Ho Jin, "Intestinal Bacterial B-Glucuronidase Activity of Patients with Colon Cancer", Arch Pharm Res vol. 24, No. 6, 564-567, 2001.
Drago, Lorenzo et al., Immunodulatory Effects of Lactobucillus salivarius LS01 and Bifidobacterium breve, Alone and in Combination on Peripheral Blood Mononuclear Cells of Allergic Asthmatics; Allergy Asthma Immunol. Res. Jul. 2015: 7(4):409-413.

(56) References Cited

OTHER PUBLICATIONS

Duck et al. 'Isolation of flagellated bacteria implicated in Crohn's disease.' Inflammatory Bowel Diseases. 2007, vol. 13, No. 10, pp. 1191-1201.
Duncan et al. "Lactate-utilizing bacteria, isolated from human feces, that produce butyrate as a major fermentation product" Applied and environmental microbiology. 2004, vol. 70, No. 10, pp. 5810-5817.
Duncan et al. (2002) "*Roseburia intestinalis* sp. nov., a novel saccharolytic, butyrate-producing bacterium from human faeces," International Journal Systematic Evolutionary Microbiology. 52:1615-1620.
Duncan et al. (2006) "Proposal of *Roseburia faecis* sp. nov., *Roseburia hominis* sp. nov. and *Roseburia inulinivorans* sp. nov., based on isolates from human faeces," International Journal of Systematic and Evolutionary Microbiology. vol. 56, No. Pt 10, pp. 2437-2441.
Duncan, et al. *Roseburia intestinalis* sp. nov., a novel saccharolytic, butyrate-producing bacterium from human faeces. Int J Syst Evol Microbiol. Sep. 2002;52(Pt 5):1615-20.
Durand et al., "Reductive Acetogenesis in Animal and Human Gut." Physiological and Clinical Aspects of Short-Chain Fatty Acids, 1995. pp. 107-117, XP000979817 Cambridge University Press ISBN 0-521-44048-3.
Eckburg, PB. et al., Diversity of the human intestinal microbial flora.Science. Jun. 10, 2005;308(5728):1635-8. Epub Apr. 14, 2005.
Elhenawy et al., Preferential packing of acidic glycosidases and proteases into bacteroides Outer membrane vesicles. mBio 5:e00909-14, pp. 1-12, 2014.
Elkins et al. 'Genes encoding bile salt hydrolases and conjugated bile salt transporters in *Lactobacillus johnsonii* 100-100 and other *Lactobacillus* species.' Microbiology. 2001, vol. 147, No. 12, pp. 3403-3412.
Elmadfa, 1., Klein, P., Meyer, AL. Immune-stimulating effects oflactic acid bacteria in vivo and in vitro (2010). Proceedings of the Nutrition Society, 69 (3), pp. 416-420.
Ely et al. (2000) "A family of six flagellin genes contributes to the Caulobacter crescentus flagellar filament," Journal of Bacteriology. 182(17):5001-5004.
Embl sequence AAO75294.1 (2003)—provided within the Office Action dated Feb. 16, 2018 in U.S. Appl. No. 15/631,952. 2 Pages.
Eren, A. Murat et al., "A single genus in the gut microbiome reflects host preference and specificity," The ISME Journal (2015) 9, 9-100 (2015).
ESR Dated Dec. 17, 2018, Appl. 18189521.0.
Estelle Devillard et al., Metabolism of Linoleic Acid by Human Gut Bacteria: Different Routes for Biosynthesis of Conjugated Linoleic Acid, Journal Of Bacteriology, Mar. 2007, vol. 189, No. 4, pp. 2566-2570.
European Communication dated Jun. 14, 2017 for EP Application No. 15817513.3.
Evelo Biosciences, Inc. Clinical Trials (Rank 1): A Study of EDP1503 in Patients With Colorectal Cancer, Breast Cancer, and Checkpoint Inhibitor Relapsed Tumors, https://clinicaltrials.gov/ct2/show/NCT03775850?spons=evelo&rank=1, 2018, accessed on Feb. 4, 2019.
Evelo Biosciences, Inc. Clinical Trials (Rank2): A Study of EDP1815 in Healthy Participants and Participants With Mild to Moderate Psoriasis and Atopic Dermatitis, https://clinicaltrials.gov/ct2/show/NCT03733353?spons=evelo&rank=2, 2018, accessed on Feb. 4, 2019.
Evelo Biosciences, Inc. Clinical Trials (Rank 3): A Study of EDP1066 in Healthy Participants and Participants With Mild to Moderate Psoriasis and Atopic Dermatitis, https://clinicaltrials.gov/ct2/show/NCT03542994?spons=evelo&rank=3, 2018, accessed Feb. 4, 2019.
Evelo Biosciences, Inc. Clinical Trials (Rank 4): Pembrolizumab and EDP1503 in Advanced Melanoma, https://clinicaltrials.gov/ct2/show/NCT03595683?spons=evelo&rank=4, 2018, accessed Feb. 4, 2019.
Evelo Biosciences, Inc. Portfolio: https://evelobio.com/portfolio/, accessed Feb. 4, 2019.
Evelo Biosciences, Inc. website: https://evelobio.com/science/, accessed Feb. 4, 2019.
Extended European search report and opinion dated Aug. 23, 2016 for EP Application No. 16166001.4.
Fabro, A. et al., The Th17 pathway in the peripheral lung microenvironment interacts with expression of collagen V in the late state of experimental pulmonary fibrosis. (2015) Immunobiology. 220(1):124-35.
Faghih, Z. et a., IL-17 and IL-4 Producing CD8+ T Cells in Tumor Draining Lymph Nodes of Breast Cancer Patients: Positive Association with Tumor Progression. (2013). Iranian Journal of Immunology. 10(4):193-204.
Fahy, J.V. Eosinophilic and neutrophilic inflammation in asthma: insights from clinical studies. Proc Am Thorac Soc. May 1, 2009;6(3):256-9. doi: 10.1513/pats.200808-087RM.
Faith et al. Identifying gut microbe-host phenotype relationships using combinatorial communities in gnotobiotic mice. Sci Transl Med 6(220):220ra11 (2014).
Faith et al. The long-term stability of the human gut microbiota. 2013. Science, 341(6141): 1237439.
Falony et al. In vitro kinetics of prebiotio inulin-type fructan fermentation by butyrateproducing colon bacteria: Implementation of online gas chromatography for quantitative analysis of carbon dioxide and hydrogen gas production. Applied and Environmental Microbiology. 2009, vol. 75, No. 18, pp. 5884-5892.
Falony, et al., Coculture Fermentations of Bifidobacterium species and bacteroides thetaiotaomicron Reveal a mechanistic insight into the prebiotic effect of inulin-type Fructans. Applied and environmental microbiology, Apr. 2009;75(8):2312-2319.
Fanning, S., Hall, L.J., Cronin, M., Zomer, A., MacSharry, J., Goulding, D., et al. (2012). Bifidobacterial surface-exopolysaccharide facilitates commensal-host interaction through immune modulation and pathogen protection. Proc Natl Acad Sci U S A 109(6), 2108-2113. doi: 10.1073/pnas.1115621109.
Farmer, et al., Gut pain & visceral hypersensitivity. British journal of pain, 2013;7(1):39-47.
Farooq, P.D. et al., Pseudomembranous colitis, Disease-A-Month 2015 Mosby Inc. USA, vol. 61, No. 5, May 1, 2015, pp. 181-206, XP009193313, ISSN: 0011-5029 p. 195.
FDA Orphan Drug Designations. Total Orphan Drugs website. Aug. 2014. Available at http://www.orphan-drugs.org/2014/09/01/fda-orphandrug-designations-august-2014. Accessed on Apr. 13, 2016.
Federico E. Rey et al., "Dissecting the in Vivo Metabolic Potential of Two Human Gut Acetogens", The Journal of Biological Chemistry, vol. 285, No. 29, p. 22082-22090, Jul. 16, 2010.
Fenner, et al., *Bacteroides massiliensis* sp. nov., isolated from blood culture of a newborn. International Journal of systematic and evolutionary microbiology, 2005. 55:1335-1337.
Ferrario, C., Milani, C., Mancabelli, L., Lugli, G.A., Duranti, S., Mangifesta, M., et al. (2016). Modulation of the eps-ome transcription of bifidobacteria through simulation of human intestinal environment. FEMS Microbiol Ecol 92(4), fiw056. doi: 10.1093/femsec/fiw056.
Flores-Langarica et al. (2012) "Systemic flagellin immunization stimulates mucosal CD1 03+ dendritic cells and drives Foxp3+ regulatory T Cell and IgA responses in the mesenteric lymph node," Journal of Immunology. 189 (12):57 45-5754.
Fraley et al. (1986) "Genetic Transformation in Higher Plants," Critical Reviews Plant Science. 4:1-46.
Frame et al., Production offertile transgenic maize plants by silicon carbide whisker-mediated transformation, The Plant Journal. 1994; 6:941-948.
Frank, D. et al., Molecular-phylogenetic characterization of microbial community imbalances in human inflammatory bowel diseases. 2007. PNAS. 104(34):13780-5.
Frick, et al., Identification of commensal bacterial strains that modulate Yersinia enterocolitica and Dextran sodium sulfate-induced inflammatory responses: implications for the development of probiotics. Infection and immunity, Jul. 2007;75(7):3490-3497.

(56) References Cited

OTHER PUBLICATIONS

Gaboriau-Routhiau et al. 'The key role of segmented filamentous bacteria in the coordinated maturation of gut helper T cell responses.' Immunity. 2009, vol. 31, No. 4, pp. 677-689.
Gait, M.J., (1984) Oligonucleotide Synthesis: A Practical Approach. Irl Press, pp. vii-xiii.
GB Exam and search report dated Aug. 30, 2016 for GB Application No. 1520638.6.
GB Search and Exam report dated Mar. 31, 2016 for GB application 1510469.8.
GB Search and Exam report dated Mar. 31, 2016 for GB application 1510470.6.
GB Search and Exam report dated Apr. 15, 2016 for GB application 1510467.2.
GB Search and Exam report dated Apr. 20, 2016 for GB application 1510466.4.
GB Search and Exam report dated Apr. 20, 2016 for GB application 1510468.0.
GB Search and Exam report dated Aug. 30, 2016 for GB application No. 1520631.1.
GB Search and Exam report dated Nov. 17, 2016 for GB application 1520502.4.
GB Search and Exam report dated Sep. 13, 2016 for GB application 1520497.7.
GB1612190.7 International Search Report dated Apr. 12, 2017.
GB1809729.5 Examination Report dated Oct. 15, 2018.
Gen Bank Accession No. ABI48297.1 (Jul. 20, 2007) "Fla1 flagellin [Roseburia hominis]".
Gen Bank Accession No. ABY J02000000 (Nov. 8, 2013) Version 2. "Roseburia intestinal is L 1-82, whole genome shotgun sequencing project".
GenBank accession No. AJ312385 (Oct. 9, 2002) "Roseburia intestinalis 16S rRNA gene, strain L1-82".
Gen Bank Accession No. CP003040 (Aug. 5, 2011) Version 1. "Roseburia Hominis A2-183, complete genome".
Gen Bank Accession No. DQ789141. (Jul. 20, 2007) "Roseburia horn in is Fla2 flagellin gene".
Gen Bank Accession No. M20983. (Apr. 26, 1993) "R.cecicola flagellin gene".
Gen Bank Accession No. NR_044054.1 (Feb. 3, 2015) Blautia wexlerae strain SSM 19850 16S ribsomal RNA gene, partial sequence.
Gen Bank Accession No. NR_117867.1 (Feb. 3, 2015) Blautia stercoris strain GAM6-1 16S ribsomal RNA gene, partial sequence.
GenBank Accession No.'s ABY J02000001—ABY J02000409 search results page (Last Updated Apr. 24, 2015).
Genbank NCBI Reference Sequence: NR_026314, Blautia hydrongentrophica strain S5a36 16S ribosomal RNA gene, partial sequence.
Genbank NCBI Reference Sequence: NR_117867.1, Blautia stercoris strain GAMC6-1 16S ribosomal RNA gene, partial sequence.
Genbank NCBI Reference Sequence: NR-044054.1, Blautia wexlerae strain DSM 19850 16S ribosomal RNA gene, partial sequence.
Gennaro, A.R. "Quality Assurance and Control," from Remington: The Science and Practice of Pharmacy, 2000, Lippincott Williams & Wilkins, 20th ed., pp. 980-983.
Geraedts et al. 'Release of satiety hormones in response to specific dietary proteins is different between human and murine small intestinal mucosa.' Annals of Nutrition and Metabolism. 2010, vol. 56, No. 4, pp. 3018-3313.
Geuking et al. 'Intestinal bacterial colonization induces mutualistic regulatory T cell responses.' Immunity. 2011, vol. 34, No. 5, pp. 794-806.
Gewirtz et al. (2001) Cutting edge: bacterial flagellin activates basolaterally expressed TLR5 to induce epithelial proinflammatory gene expression. The Journal of Immunology. 167:(4)1882-1885.
Ghadimi, D. et al., Epigenetic imprinting by commensal probiotics inhibits the IL-23/IL-17 axis in an in vitro model of the intestinal mucosal immune system. JLB. 2012;92(4):895-911.

Giraud et al. 'Dissecting the genetic components of adaptation of Escherichia coli to the mouse gut.' PLoS Genetics.2008, vol. 4, No. 1, pp. e2.
Goldin, B.R. et al., Clinical indications for probiotics: an overview. Clin Infect Dis. Feb. 1, 2008;46 Suppl 2:S96-100; discussion S144-51. doi: 10.1086/523333.
Gonzalez-Rodriguez, I., Sanchez, B., Ruiz, L., Turroni, F., Ventura, M., Ruas-Madiedo, P., et al. (2012). Role of extracellular transaldolase from Bifidobacterium bifidum in mucin adhesion and aggregation. Appl Environ Microbiol 78(11), 3992-3998. doi: 10.1128/AEM.08024-11.
Gopal, P.K., Sullivan, P.A., Smart, J.B. Utilization of galacto-oligosaccharides as selective substrates for growth by lactic acid bacteria including Bifidobacterium lactis DR10 and Lactobacillus rhamnosus DR20 (200 1). International Dairy Journal, 11 (1-2), pp. 19-25.
Gousia, P., et al., Antimicrobial resistance of major foodborne pathogens from major meat products (20II). Foodborne Pathogens and Disease, 8 (1), pp. 27-38.
Greenspan et al., Defining epitopes: It's not as easy as it seems. Nature Biotechnology 7: 936-937, 1999.
Groeger, D., O'Mahony, L., Murphy, E.F., Bourke, J.F., Dinan, T.G., Kiely, B., et al. (2013). Bifidobacterium infantis 35624 modulates host inflammatory processes beyond the gut. Gut Microbes 4(4), 325-339. doi: 10.4161/gmic.25487.
GT Biologies obtains FDA orphan drug designation for paediatric crohn's drug, pharmaceutical-technology.com news, Oct. 8, 2013. Available at: http://www.pharmaceutical-technology.com/news/newsgt-biologics-obtains-fda-orphan-drug-designation-for-paediatric-crohns-drug?WT.mc_id=DN_News.
Haabeth et al. A model for cancer-suppressive inflammation. (2012) Oncolmmunology 1(1):1146-1152.
Hammerich, L. et al., Interleukins in chronic liver disease: lessons learned from experimental mouse models. (2014) Clin Exp Gastroenterol. 7:297-306.
Hansen, et al., The role of mucosal immunity and host genetics in defining intestinal commensal bacteria. 2010. Curr. Opin. Gastroenterol., 26(6): 564-571.
Hapfelmeier et al. 'Reversible microbial colonization of germ-free mice reveals the dynamics of IgA immune responses.' Science. 2010, vol. 328, No. 5986, pp. 1705-1709.
Hayashi et al. The innate immune response to bacterial flagellin is mediated by Toll-like receptor 5. Nature. 2001, vol. 410, No. 6832, pp. 1099-1103.
Heberle, H., Meirelles, G.V., da Silva, F.R., Telles, G.P., and Minghim, R. (2015). InteractiVenn: a web-based tool for the analysis of sets through Venn diagrams. BMC Bioinformatics 16(1), 169. doi: 10.1186/s12859-015-0611-3.
Hedayat et al. (Mar. 1, 2012) "Prophylactic and therapeutic implications of toll-like receptor ligands," Medicinal Research Reviews. 32(2):294-325.
Heuvelin, E., Lebreton, C., Grangette, C., Pot, B., Cerf-Bensussan, N., and Heyman, M. (2009). Mechanisms Involved in Alleviation of Intestinal Inflammation by Bifidobacterium Breve Soluble Factors. PLOS ONE 4(4), e5184. doi: 10.1371/journal.pone.0005184.
Hidalgo-Cantabrana, C., Lopez, P., Gueimonde, M., de Los Reyes-Gavilan, C.G., Suarez, A., Margolles, A., et al. (2012). Immune Modulation Capability of Exopolysaccharides Synthesised by Lactic Acid Bacteria and Bifidobacteria. Probiotics Antimicrob Proteins 4(4), 227-237. doi: 10.1007/s12602-012-9110-2.
Hidalgo-Cantabrana, C., Sanchez, B., Alvarez-Martin, P., Lopez, P., Martinez-Alvarez, N., Delley, M., et al. (2015). A single mutation in the gene responsible for the mucoid phenotype of *Bifidobacterium animalis* subsp. *lactis* confers surface and functional characteristics. Appl Environ Microbiol 81(23), 7960-7968. doi: 10.1128/AEM.02095-15.
Hidalgo-Cantabrana, C., Sanchez, B., Milani, C., Ventura, M., Margolles, A., and Ruas-Madiedo, P. (2014). Genomic overview and biological functions of exopolysaccharide biosynthesis in *Bifidobacterium* spp. Appl Environ Microbiol 80(1), 9-18. doi: 10.1128/AEM.02977-13.
Higgins, et al. Clustal: A Package for Performing Multiple Sequence Alignment on a Microcomputer. Gene. 73 (1988): 237-244.

(56) References Cited

OTHER PUBLICATIONS

Hinchliffe (1993) "Yeast as a vehicle for the expression of heterologous genes," Yeasts. 2nd edition. Rose, A. R.; Harrison, J. H.: Eds. Academic Press Ltd. 5(9). pp. 325-356.
Hinnen et al., Transformation of yeast, Proc. Natl. Acad. Sci. USA. Apr. 1978; 75:1929-1933.
Hoarau et al.: "TLR2 Activation By Supernatant From Bifidobacterium Breve Modulates Maturation And Survival Of Human DCs Via Differential Effects On PI3Kinase, p38 And ERK Pathways",Journal of Allergy and Clinical Immuno, Elsevier, Amsterdam, Nl, vol. 119, No. 1, Jan. 1, 2007 (Jan. 1, 2007), p. S258, XP005756921, ISSN: 0091-6749, DOI: 10.1016/J.JACI.2006.12.377 *cf. abs.No. 1008 at p. S258*.
Hoarau, Cyrille et al., Supernatant from Bifidobacterium Differentially Modulates Transduction Signaling Pathways for Biological Functions of Human Dendritic Cells, PLOS ONE, Public Library of Science, US, vol. 3, No. 7, Jul. 1, 2008 (Jul. 1, 2008), p. e2753-1, XP009139666,ISSN: 1932-6203 *cf. abstract and conclusion, furthermore discussion part at p. 3, col. at the right side*.
Hoekema (1985) The Binary Plant Vector System Offset-drukkerij Kanters BB, Alblasserdam. Chapter V. pp. 63-71.
Hold et al. 'Oligonucleotide probes that detect quantitatively significant groups of butyrateproducing bacteria in human feces.' Applied and environmental microbiology. 2003, vol. 69, No. 7, pp. 4320-4324.
Holdeman, et al., Eubacterium contortum (Prevot) comb, nov.: Emendation of description and designation of the type strain. International journal of systematic bacteriology. Oct. 1971;21(4): 304-306.
Holland et al. (1990) "Secretion of Heterologous Proteins in *Escherichia coli*," Methods Enzymology. 182:132-143.
Hollenberg et al. (1997) "Production of recombinant proteins by methulotrophic yeasts," Current Opinion Biotechnology. 8(5):554-560.
Hooper at al. 'Molecular analysis of commensal host-microbial relationships in the intestine.' Science. 2001; vol. 291, No. 5505, pp. 881-884.
Horn, et al., Synthesis of Oligonucleotides on Cellulose. Part II: Design and Synthetic Strategy to the Synthesis of 22 Oligodeoxynucleotides Coding for Gastric Inhibitory Polypeptide (GIP). 1980. Nuc Acids Res Symp Ser 225-232.
Horwell, et al., The 'peptoid' approach to the design of non-peptide, small molecule agonists and antagonists of neuropeptides. 1995. Trends Biotechnol. 13(4):132-134.
Hossain et al. "Flagellin, a TLR5 agonist, reduces graft-versus-host disease in allogeneic hematopoietic stem cell transplantation recipients while enhancing antiviral immunity," Journal of Immunology. Nov. 2011; 187(10): p. 5130-5140.
Hougee, et al., Oral treatment with probiotics reduces allergic symptoms in ovalbumin-sensitized mice:a bacterial strain comparative study. Int Arch Allergy Immunol. 2010; 151:107-117.
Hoyles L. et al. Gastrointestinal Tract, Chapter 56. Handbook of Hydrocarbon and Lipid Microbiology Springer Verlag Berlin 2010, 3120-32.
Hughes, K.R., Harnisch, L.C., Alcon-Giner, C., Mitra, S., Wright, C.J., Ketskemety, J., et al. (2017). Bifidobacterium breve reduces apoptotic epithelial cell shedding in an exopolysaccharide and MyD88-dependent manner. Open Biol 7(1). doi: 10.1098/rsob. 160155.
Hyland and Cox, "The regulation of veratridine-stimulated electrogenic ion transport in mouse colon by neuropeptide Y (NPY), Y1 and Y2 receptors", 2005, British Journal of Pharmacology,146(5), 712-722.
Hytönen, J., Haataja, S., and Finne, J. (2003). *Streptococcus pyogenes* Glycoprotein-Binding Strepadhesin Activity Is Mediated by a Surface-Associated Carbohydrate-Degrading Enzyme, Pullulanase. Infection and Immunity 71(2), 784-793.
Hytonen, J., Haataja, S., and Finne, J. (2006). Use of flow cytometry for the adhesion analysis of *Streptococcus pyogenes* mutant strains to epithelial cells: investigation of the possible role of surface pullulanase and cysteine protease, and the transcriptional regulator Rgg. BMC Microbiol 6, 18. doi: 10.1186/1471-2180-6-18.
Ibrahim et al., "Method for the isolation of highly purified *Salmonella* flagellins," Journal of Clinical Microbiology. Dec. 1985; 22(6):1040-1044.
Inaba et al., "Generation of large numbers of dendritic cells from mouse bone marrow cultures supplemented with granulocyte/macrophage colony-stimulating factor," J. Exp. Med. Dec. 1992; 176(6):1693-1702.
Interational Search Report for International Application No. PCT/GB2012/052495, dated Mar. 25, 2013.
International Preliminary Report dated Mar. 1, 2017 for International Application No. PCT/GB2015/054113.
International Preliminary Report on Patentability corresponding to International Patent Application No. PCT/GB2014/051123, dated Oct. 13, 2015.
International Preliminary Report on Patentability for International Application No. PCT/GB2012/051686 dated Jan. 14, 2014.
International Search Report dated Jan. 27, 2017 for International Application No. PCT/GB2016/053622.
International Search Report dated Feb. 10, 2016 for International Application No. PCT/GB2015/054113.
International Search Report dated Feb. 17, 2017 for International Application No. PCT/GB2016/053676.
International Search Report dated Mar. 7, 2016 for International Application No. PCT/GB2015/054112.
International Search report dated Mar. 15, 2003 for International Application No. PCT/GB2002/05255.
International Search Report dated Aug. 21, 2014 for International Application No. PCT/GB2014/051123.
International Search Report dated Aug. 26, 2016 for International application No. PCT/GB2016/051774.
International Search Report dated Aug. 26, 2016 for International application No. PCT/GB2016/051776.
International Search Report dated Sep. 6, 2016 for International application No. PCT/GB2016/051768.
International Search Report dated Sep. 6, 2016 for International application No. PCT/GB2016/051773.
International Search Report dated Sep. 6, 2016for International application No. PCT/GB2016/051770.
International Search Report dated Feb. 2, 2017 for International application No. PCT/GB2016/053620.
International Search Report dated Mar. 6, 2017 for International Application No. PCT/GB2016/053677.
International Search Report for International Application No. PCT/GB2012/051686 dated Jan. 31, 2013.
International search report with written opinion dated Feb. 26, 2018 for PCT/GB2017/053722.
International search report with written opinion dated Jun. 8, 2017 for GB Application No. 1616016.
International search report with written opinion dated Sep. 29, 2017 for GB Application No. 1621123.
International search report with written opinion dated Oct. 16, 2017 for PCT/GB2017/052076.
Inturri, R., Molinaro, A., Di Lorenzo, F., Blandino, G., Tomasello, B., Hidalgo-Cantabrana, C., et al. (2017). Chemical and biological properties of the novel exopolysaccharide produced by a probiotic strain of Bifidobacterium longum. Carbohydr Polym 174,1172-1180. doi: 10.1016/j.carbpol.2017.07.039.
Ishikawa, et al., Effect of bifidobacteria to suppress Th17, Food Science and technology institute, 2008, 5 Pages.
Ispirli, H. et al., Characterization of functional properties of Enterococcus faecium strains isolated from human gut.Can. J. Microbiol. 61: 861-870 (2015) dx.doi.org/10.1139/cjm-2015-0446.
Israel, E. et al., Supplementary Appendix, Severe and difficult-to-treat asthma in adults. N. Engl J Med 2017;p. 377:965-76. DOI: 10.1056/NEJMra1608969.
Israel, et al., Severe and difficult-to-treat asthma in adults, The New England Journal of Medicine, Sep. 2017; 377(10):965-976.
Issue Notification dated Feb. 20, 2019 for Co-Pending U.S. Appl. No. 15/631,945.
Ito et al. (1983) "Transformation of Intact Yeast Cells Treated with Alkali Cations," J. Bacteriology. 153:163-168.

(56) References Cited

OTHER PUBLICATIONS

Ivanov et al. 'Induction of intestinal Th17 cells by segmented filamentous bacteria.' Cell. 2009, vol. 139, No. 3, pp. 485-498.
Ivanov, D., Emonet, C., Foata, F., Affolter, M., Delley, M., Fisseha, M., et al. (2006). A serpin from the gut bacterium Bifidobacterium longum inhibits eukaryotic elastase-like serine proteases. J Biol Chem 281(25), 17246-17252. doi: 10.1074/jbc.M601678200.
Jackson MS, Bird AR, McOrist AL. Comparison of two selective media for the detection and enumeration of Lactobacilli in human faeces (2002). J Microbial Methods. 51 (3), pp. 313-321.
Jagveer Singh et al., "Bifidobacterium longum, a lactic acid-producing intestinal bacterium inhibits colon cancer and modulates the intermediate biomarkers of colon carcinogenesis", Carcinogenesis vol. 18 No. 4 pp. 833-841, 1997.
Jarchum et al., "Toll-Like Receptor 5 Stimulation Protects Mice from Acute Clostridium difficile Colitis," Infection and Immunity. Apr. 2011; 79(4):1498-1503.
Jawad, S. et al., Elevated serum levels of interleukin-17A in uveitis patients. Ocul Immunol Inflamm. Dec. 2013;21(6):434-9. doi: 10.3109/09273948.2013.815786. Epub Aug. 19, 2013.
Jenq, Robert M., Intestinal Bluatia is associated with reduced death from graft versus-host disease, Bio Blood Marro Transplant. Aug. 2015; 21(8): 1373-1383. doi:10.1016/j.bbmt.2015.04.016.
Jeon, S.G., Kayama, H., Ueda, Y., Takahashi, T., Asahara, T., Tsuji, H., et al. (2012). Probiotic Bifidobacterium breve induces IL-10-producing Tr1 cells in the colon. PLoS Pathog 8(5), e1002714. doi: 10.1371/journal.ppat.1002714.
Jiao et al., Blockade of Notch Signaling Ameliorates Murine Collagen-Induced Arthritis via Suppressing Th1 and Th17 Cell Responses. 2014; Pathology, 184(4):1085-1093.
Joblin K N., "Ruminal Acetogens and Their Potential to Lower Remnant Methane Emissions." Australian Journal of Agricultural Research, vol. 50. No. 8. 1999, pp. 1307-1313. XP001010439.
Kailasapathy, K. Microencapsulation of Probiotic Bacteria:Technology and Potential Applications. Curr. Issues Intest. Microbiol. (2002) 3: 39-48.
Kanauchi, et al., Eubacterium limosum ameliorates experimental colitis and metabolite of microbe attenuates colonic inflammatory action with increase of mucosal integrity introduction, China World J Gastroenterol February, Jan. 1, 2006. pp. 1071-1077.
Kanauchi, et al., Eubacterium limosum (probiotic) and its metabolites showed anti-inflammatory effects and increased mucosal barrier function in colitis. Gastroenterology, 2005;128: p. A281, XP009193489.
Kang et al. (2010) "Dysbiosis of fecal microbiota in Crohn's disease patients as revealed by a custom phylogenetic microarray," Inflammatory Bowel Diseases. 16(12):2034-2042.
Kang, S. et al., Dysbiosis of fecal microbiota in Crohn's disease patients as revealed by a custom phylogenetic microarray.Inflamm Bowel Dis. Dec. 2010;16(12):2034-42. doi: 10.1002/ibd.21319.
Kantak PA et al., "Obsessive-compulsive-like behaviors in house mice are attenuated by a probiotic (Lactobacillus rhamnosus GG)", Behav Pharmacol. Feb. 2014;25(1):71-9. doi: 10.1097/FBP.0000000000000013.
Karaffova, et al., Interaction of TGF-B4 and IL-17 with IgA secretion in the intestine of chickens fed with E. faecium AL41 and challenged with S. Enteritidis. Research in Veterinary science. 2015:75-79.
Kari Shoaf et al., "Prebiotic Galactooligosaccharides Reduce Adherence of Enteropathogenic Escherichia coli to Tissue Culture Cells", Infection and Immunity, Dec. 2006, vol. 74. No. 12, p. 6920-6928.
Karin, M. Nuclear factor-kappaB in cancer development and progression. Nature. May 25, 2006;441(7092):431-6.
Keller et al.. "DNA Probes", 1994. Stockton Press. New York. XP002158943 108660 pp. 594-596.
Kelly et al. 'Commensal anaerobic gut bacteria attenuate inflammation by regulating nuclear-cytoplasmic shuttling of PPAR-y and ReiA.' Nature Immunology. 2003, vol. 5, No. 1, pp. 104-112.
Kelly, et al., Commensal gut bacteria: mechanisms of immune modulation. Trends in immunology, 2005;26(6):326-333.

Kingsley M. A Personalized Approach to Managing 18D. Gastroenterology and Hepatology 12(5)308-315, May 2016.
Kinnebrew et al., Interleukin 23 production by intestinal CD1 03(+)CD11 b(+) dendritic cells in response to Interleukin 23 production by intestinal CD1 03(+ )CD11 b(+) dendritic cells in response to bacterial flagellin enhances mucosal innate immune defense, Immunity. 2012; 36(2): 276-287.
Kinoshita, H., Uchida, H., Kawai, Y., Kawasaki, T., Wakahara, N., Matsuo, H., et al. (2008). Cell surface Lactobacillus plantarum LA 318 glyceraldehyde-3-phosphate dehydrogenase (GAPDH) adheres to human colonic mucin. J Appl Microbiol 104(6), 1667-1674. doi: 10.1111/j.1365-2672.2007.03679.x.
Kirsty Minton: Mucosal immunology: The ins and outs of gut inflammation, The journal of immunology, 4(2), Feb. 1, 2004: pp. 81-81, XP055252701.
Kishimoto, M., Nomoto, R., Mizuno, M., and Osawa, R. (2017). An in vitro investigation of immunomodulatory properties of Lactobacillus plantarum and L. delbrueckii cells and their extracellular polysaccharides. Bioscience of Microbiota, Food and Health 36(3), 101-110. doi: 10.12938/bmfh.17-001.
Kitahara et al., Bacteroides plebeius sp. nov. and Bacteroides coprocola sp. nov., isolated from human faeces, 2005; Int J Syst Ev Microbiol 55: 2143-47.
Kitahara, M. et al., Bacteroides plebeius sp. nov. and Bacteroides coprocola sp. nov., isolated from human faeces. International journal of systematic and evolutionary microbiology. 2005; 55: 2143-2147.
Koenders, M.I. et al., Interleukin-17 Acts Independently of TNF-a under Arthritic Conditions. (2006) J. Immunol. 176:6262-6269.
Kogyo, S. Lactic Acid Bacteria, Intestinal Flora ad Health II; Physiological effects of heat-treated lactococcus "EF-2001" and application to food. Mar. 30, 2001, vol. 44, No. 6, pp. 35-39.
Koh, Gar Yee et al., Parabacteroides distasonis attenuate toll-like receptor 4 signalling and Akt activation and blocks colon tumor formulation in high-fat-diet-fed azoxymethane-treated mice, International Journal of Cancer, pp. 1-30. Accepted Article, doi: 10.1002/ijc.31559.
Korhonen, J.M., Sclivagnotis, Y., Von Wright, A Characterization of dominant cultivable lactobacilli and their antibiotic resistance profiles from faecal samples of weaning piglets (2007). Journal of Applied Microbiology, 103 (6), pp. 2496-2503.
Kumolosasi, E., Salim, E., Jantan, I., and Ahmad, W. (2014). Kinetics of Intracellular, Extracellular and Production of Pro-Inflammatory Cytokines in Lipopolysaccharide-Stimulated Human Peripheral Blood Mononuclear Cells. Tropical Journal of Pharmaceutical Research 13(4), 536-543. doi: 10.4314/tjpr.v13i4.8.
Kverka, M. et al., Oral administration of Parabacteroides distasonis antigens attenuates experimental murine colitis through modulation of immunity and microbiota composition. Clinical & Experimental Immunology. 2010; 163:250-259.
Laetitia Rodes et al., "Microencapsulated Bifidobacterium longum subsp. infantis ATCC 15697 Favorably Modulates Gut Microbiota and Reduces Circulating Endotoxins in F344 Rats", BioMed Research International, vol. 2014, Article ID 602832, 11 pages.
Lahteinen, T., et al., A Pro biotic properties of Lactobacillus isolates originating from porcine intestine and feces (20 10) Anaerobe, 16 (3), pp. 293-300.
Lakhdari, et al. Identification of NF-KB Modulation Capabilities within Human Intestinal Commensal Bacteria. J Biomed Biotechnol. 2011; 2011: 282356.
Laukova, A. et al. Benefits of Combinative Application of Probiotic, Enterocin M-Producing Strain Enterococcus Faecium AL41 and Eleutherococcus Senticosus in Rabbits. Folia Microbiol (Praha) 61 (2), 169-177. Sep. 9, 2015.
Laureen Crouzet et al., "The altered gut microbiota of IBS patients plays a key role in visceral hypersensitivity: specific role of sulphate-reducing bacteria", INRA Symposium, 2012.
La Vallie et al. (1995) "Gene fusion expression systems in Escherichia coli," Current Opinion Biotechnology. 6 (5):501-506.
Law, J., Buist, G., Haandrikman, A., Kok, J., Venema, G., and Leenhouts, K. (1995). A system to generate chromosomal mutations in Lactococcus lactis which allows fast analysis of targeted genes. Journal of Bacteriology 177(24), 7011-7018.

(56) References Cited

OTHER PUBLICATIONS

Lebeer, S., Claes, I.J., Verhoeven, T.L., Vanderleyden, J., and De Keersmaecker, S.C. (2011). Exopolysaccharides of Lactobacillus rhamnosus GG form a protective shield against innate immune factors in the intestine. Microb Biotechnol 4(3), 368-374. doi: 10.1111/j.1751-7915.2010.00199.x.

Lebeer, S., Verhoeven, T.L., Francius, G., Schoofs, G., Lambrichts, I., Dufrene, Y., et al. (2009). Identification of a Gene Cluster for the Biosynthesis of a Long, Galactose-Rich Exopolysaccharide in Lactobacillus rhamnosus GG and Functional Analysis of the Priming Glycosyltransferase. Appl Environ Microbiol 75(11), 3554-3563. doi: 10.1128/AEM.02919-08.

Lee, et al. Intestinal microbiota in pathophysiology and management of irritable bowel syndrome . 2014. World J Gastroenterol. 20(27): 8886-8897.

Lejeune et al. Efficiency of Recombinant Human TNF in Human Cancer Therapy. Cancer Immun. 6:6 (2006).

Leser et al. 'Culture-independent analysis of gut bacteria: the pig gastrointestinal tract microbiota revisited'. Applied and Environmental Microbiology. 2002, vol. 68, No. 2, pp. 673-690.

Leslie, et al., Trehalose and sucrose protect both membranes and proteins in intact bacteria during drying. (1995) Appl. Environ. Microbiol. 61, 3592-3597.

Letran et al. 'TLR5-deficient mice lack basal inflammatory and metabolic defects but exhibit impaired CD4 T cell responses to a flagellated pathogen.' The Journal of Immunology. 2011, vol. 186, No. 9, pp. 5406-5412.

Li, C.Y., Lin Hc Fau—Lai, C.-H., Lai Ch Fau—Lu, J.J.-Y., Lu Jj Fau—Wu, S.-F., Wu Sf Fau—Fang, S.-H., and Fang, S.H. (2011). Immunomodulatory effects of lactobacillus and Bifidobacterium on both murine and human mitogen-activated T cells. Int Arch Allergy Immunol 156(2), 128-136. doi: 10.1159/000322350.

Li, et al.,. Screening and Identification of Lactobacillus animalis strain and characteristics of its bacteriostatic protein, Weishengwuxue Tongbao 2009; 36(7): 1001-1007.

Lilley et al., Methods in Enzymology; DNA Structure Part A: Synthesis and Physical Analysis of DNA. 1992; vol. 2011. pp. v-vii.

Liu et al. Reclassification of Clostridium coccoides, Ruminococcus hansenii, Ruminococcus hydrogenotrophicus, Ruminococcus luti, Ruminococcus productus and Ruminococcus schinkii as *Blautia coccoides* gen. nov., comb, nov., Blautia hansenii comb. nov., Blautia hydrogenotrophica comb, nov., Blautia luti comb, nov., Blautia producta comb, nov., Blautia schinkii comb. nov. and description of *Blautia wexlerae* sp. nov., isolated from human faeces. 2008. Int J Syst Evol Microbiol 58, 1896-1902.

Liu, Chang-jian et al., Antioxidant and Cholesterol-Reducing Properties of Enterococcus gallinarum m661, Bioengineering (Food Science), vol. 34, No. 7, Dec. 31, 2013, pp. 157-161.

Liu, Y., et al., Human-derived probiotic Lactobacillus reuteri strains differentially reduce intestinal inflannuation (20 10). American Journal of Physiology—Gastrointestinal and Liver Physiology, 299 (5), pp. G1087-G1096.

Ljungh, A, Wadstrorn, T. Lactic acid bacteria as probiotics (2006). Current Issues in Intestinal Microbiology, 7 (2), pp. 73-90.

Lodemann, U et al., Effects of the Probiotic enterococcus faecium and pathogenic *Escherichia coli* strains in a pig and human epithelial intestinal cell model. Hindawi publishing corporation scientifica. 2015(235184) 10 pages.

Lopetuso et al. Commensal Clostridia: leading players in the maintenance of gut homeostasis. 2013. Gut Pathogens, 5: 23.

López, P., González-Rodríguez, I., Gueimonde, M., Margolles, A., and Suárez, A. (2011). Immune Response to Bifidobacterium bifidum Strains Support Treg/Th17 Plasticity. PLOS ONE 6(9), e24776. doi: 10.1371/journal.pone.0024776.

Lopez, P., Gonzalez-Rodriguez, I., Sanchez, B., Ruas-Madiedo, P., Suarez, A., Margolles, A., et al. (2012). Interaction of Bifidobacterium bifidum LMG13195 with HT29 cells influences regulatory-T-cell-associated chemokine receptor expression. Appl Environ Microbiol 78(8), 2850-2857. doi: 10.1128/AEM.07581-11.

López, P., Gueimonde, M., Margolles, A., and Suárez, A. (2010). Distinct Bifidobacterium strains drive different immune responses in vitro. International Journal of Food Microbiology 138(1), 157-165. doi: https://doi.org/10.1016/j.ijfoodmicro.2009.12.023.

Lopez-Boado, Y. S. et al., Bacterial Exposure Induces and Activates Matrilysin in Mucosal Epithelial Cells. J Cell Biol148, 1305-1315 (2000).

Louis et al. 'Diversity of human colonic butyrate-producing bacteria revealed by analysis of the butyryl-GoA: acetate GoA-transferase gene.' Environmental Microbiology. 2010, vol. 12, No. 2, pp. 304-314.

Louis et al. 'Diversity, metabolism and microbial ecology of butyrate-producing bacteria from the human large Intestine.' FEMS Microbiology Letters. 2009, vol. 294, No. 1, pp. 1-8.

Louis et al. 'Organization of butyrate synthetic genes in human colonic bacteria: phylogenetic conservation and horizontal gene transfer.' FEMS Microbiology Letters. 2007, vol. 269, No. 2, pp. 240-247.

LOZUPONE. Diversity, stability and resilience of the human gut microbiota. 2012. Nature. Sep. 13, 2012; 489 (7415): 220-230.

Luger, D. and Caspi, R.R., New perspectives on effector mechanisms in uveitis. (2008) Semin. Immunopathol. 30(2): 134-143.

Lyons, et al., Bacterial strain-specific induction of Foxp3 T regulatory cells is protective in murine allergy models. Clinical & Experimental Allergy. 2010; 40:811-819.

Machiels, et al., Predominant dysbiosis in patients with ulcerative colitis is different from Crohn's disease patients, Inflammatory Bowel Diseases, Microbiology 2012. Sth Congress of ECCO. (This Abstract is In 7th Congress 2012).

Machiels, K. A decrease of the butyrate-producing species Roseburia hominis and Faecalibacterium prausnitzii defines dysbiosis in patients with ulcerative colitis.Gut. Aug. 2014;63(8):1275-83. doi: 10.1136/gutjnl-2013-304833. Epub Sep. 10, 2013.

Macpherson et al. 'IgA adaptation to the presence of commensal bacteria in the intestine.' Gut-Associated Lymphoid Tissues. Springer Berlin Heidelberg, 2006. 117-136.

Macpherson, AJ. et al., IgA responses in the intestinal mucosa against pathogenic and non-pathogenic microorganisms. Oct. 2001. 3(12). 1021-1035.

Macpherson, AJ., et al., The functions of mucosal T cells in containing the indigenous commensal flora of the intestine.Cell Mol Life Sci. Dec. 2002;59(12):2088-96.

Macsharry et al., Immunomodulatory effects of feeding with bifidobacterium longum on allergen-induced lung inflammation in the mouse. Pulmonary pharmacology & Therapeutics. 2012;25:325-334.

Mahowald et al. 'Characterizing a model human gut microbiota composed of members of its two dominant bacterial phyla.' Proceedings of the National Academy of Sciences. 2009, vol. 106, No. 14, pp. 5859-5864.

Maintaining Cultures for Biotechnology and Industry (1996) Jennie C. Hunter-Cevera, Academic Press.

Mallya et al. 'Characterization of the five novel Ly—6 superfamily members encoded in the MHC, and detection of cells expressing their potential ligands.' Protein Science. 2006, vol. 15, No. 10, pp. 2244-2256.

Manni et al., A tale of two cytokines: IL-17 and IL-22 in asthma and infection. Expert Rev RespirMed. Feb. 2014 ; 8(1): 25-42. doi:10.1586/17476348.2014.854167.

Mansour et al. Isolation of Enterococcus faecium NM113, Enterococcus faecium NM213 and Lactobacillus easel NM512 as novel probiotics with immunomodulatory properties. (2014) Microbiol Immunol. 58(10):559-69.

Martin et al., Cloning, Nucleotide Sequence, and Taxonomic Implications of the Flagellin Gene of Roseburia cecicola, Journal of Bacteriology. Jun. 1988; 170(6):2612-2617.

Martin R. et al., Isolation of lactobacilli from sow milk and evaluation of their probiotic potential. J of dairy research 76(4)418-425. Nov. 2009.

Masco, L., et al., Identification of Bifidobacterium Species Using rep-PCR Fingerprinting. Systematic and Applied Microbiology 26(4):557-63 • Dec. 2003.

(56) References Cited

OTHER PUBLICATIONS

Matsuda F et al.: Evaluation of a probiotics,BBG-01, for enhancement of immunogenicity of an oral inactivated cholera vaccine and safety: A randomized, double-blind, placebo-controlled trial in Bangladeshi children under 5 years of age,Vaccine, Elsevier, Amsterdam, NL, vol. 29, No. 10, Dec. 26, 2010 (Dec. 26, 2010), pp. 1855-1858, XP028147184, ISSN: 0264-410X, DOI: 10.1016/J.VACCINE.2010.12.133 [retrieved on Jan. 7, 2011] *cf. abstract*.
Matthes, et al., Simultaneous rapid chemical synthesis of over one hundred oligonucleotides on a microscale. Apr. 1984. EMBO Journal, 3(4): p. 801-805.
Maya, J.R. et al., Emerging Therapies for Noninfectious Uveitis: What May Be Coming to the Clinics. (2014) J. Ophthalmology. 310329.
Mazmanian et al. 'An immunomodulatory molecule of symbiotic bacteria directs maturation of the host immune system.' Cell. 2005, vol. 122, No. 1, pp. 107-118.
Mazmanian, SK., An immunomodulatory molecule of symbiotic bacteria directs maturation of the host immune system.Cell. Jul. 15, 2005;122(1):107-18.
Mccarville, J.L., Dong, J., Caminero, A., Bermudez-Brito, M., Jury, J., Murray, J.A., et al. (2017). A Commensal Bifidobacterium longum Strain Prevents Gluten-Related Immunopathology in Mice through Expression of a Serine Protease Inhibitor. Applied and Environmental Microbiology 83(19), e01323-01317. doi: 10.1128/AEM.01323-17.
McClymont, S.A., Putnam AI Fau—Lee, M.R., Lee Mr Fau—Esensten, J.H., Esensten Jh Fau—Liu, W., Liu W Fau—Hulme, M.A., Hulme Ma Fau—Hoffmuller, U., et al. (2011). Plasticity of human regulatory T cells in healthy subjects and patients with type 1 diabetes. Journal of Immunology 186(7), 3918-3926. doi: 10.4049/jimmunol.1003099.
Mcintosh et al. 'Mechanism of conjugated linoleic acid and vaccenic acid formation in human faecal suspensions and pure cultures of intestinal bacteria.' Microbiology. 2009, vol. 155, No. 1, pp. 285-294.
Mclaughlin., "Mclaughlin et al. Fatty acid chain length determines cholecystokinin secretion and effect on human gastric motility. Gastroenterology. 1999, vol. 116, No. 1, pp. 46-53".
Menard, S., Laharie D Fau—Asensio, C., Asensio C Fau—Vidal-Martinez, T., Vidal-Martinez T Fau—Candalh, C., Candalh C Fau—Rullier, A., Rullier A Fau—Zerbib, F., et al. (2005). Bifidobacterium breve and *Streptococcus thermophilus* secretion products enhance T helper 1 immune response and intestinal barrier in mice. Experimental Biology and Medicine (Maywood) 230(10), 749-756.
Meyer et al. (1992) "The use of cassava mosaic virus as a vector system for plants," Gene. 110:213-217.
Meyza, et al. The BTBR mouse model of idiopathic autism—Current view on mechanisms. 2017. Neurosci Biobehav Rev.;76(Pt A):99-110.
Mikayama, et al., Molecular cloning and functional expression of a cDNA encoding glycosylation-inhibiting factor. Proc.Nati.Acad.Sci. USA, Nov. 1993; vol. 90: 10056-1 0060.
Milani, C., Mangifesta, M., Mancabelli, L., Lugli, G.A., Mancino, W., Viappiani, A., et al. (2017). The Sortase-Dependent Fimbriome of the Genus *Bifidobacterium*: Extracellular Structures with Potential To Modulate Microbe-Host Dialogue. Appl Environ Microbiol 83(19). doi: 10.1128/AEM.01295-17.
Mincheol Kim et al., "Towards a taxonomic coherence between average nucleotide identity and 16S rRNA gene sequence similarity for species demarcation of prokaryotes", International Journal of Systematic and Evolutionary Microbiology (2014), 64, 346-351.
Miossec et al., Targeting IL-17 and TH17 cells in chronic inflammation, 2012; Nature Drug Discovery 11, 763-776.
Miossec, P. et al. Targeting IL-17 and TH17 cells in chronic inflammation. Nat Rev Drug Discov. Oct. 2012;11(10):763-76. doi: 10.1038/nrd3794.
Miraglia Del Giudice, M., Indolfi, C., Capasso, M., Maiello, N., Decimo, F., and Ciprandi, G. (2017). Bifidobacterium mixture (B longum BB536, B infantis M-63, B breve M-16V) treatment in children with seasonal allergic rhinitis and intermittent asthma. Italian Journal of Pediatrics 43(1), 25. doi: 10.1186/s13052-017-0340-5.
Mitropoulou, G. et al. Immobilization Technologies in Probiotic Food Production. (2013) Journal Nutr Metab. (2013) 716861.
Miyake, et al., Phylogenetic analysis of the genus bifidobacterium and related genera based on 16S rDNA sequences. Microbiol. Immunol. 1998; 42(10): 661-667.
Miyake, T. et al., Phylogenetic Analysis of the Genus Bifidobacterium and Related Genera Based on 16S rDNA Sequences. Microbiol. Immunol. 1998; 42(10):661-667.
Miyamoto-Shinohara et al. Survival of freeze-dried bacteria. J Gen Appl Microbiol 54(1):9-24 (2008).
Miyauchi, E., Control of multiple sclerosis by gut microbiota. Journal of clinical and experimental medicine. 2015. vol. 253 No. 5.2, pp. 445-450.
Molecular Biology Techniques, 1st edition. An intensive laboratory course. 1998.
Monteleone et al., IL-10-dependent partial refractoriness to Toll-like receptor stimulation modulates gut mucosal dendritic cell function, European Journal of Immunology. 2008; 38(6):1533-1547.
Monteleone, I. et al., Th17-related cytokines: new players in the control of chronic intestinal inflammation. (2011) BMC Medicine. 2011, 9:122.
Mortaz, E. et, al., Anti-Inflammatory Effects of Lactobacillus Rahmosus and Bifidobacterium Breve on Cigarette Smoke Activated Human Mcrophiages, PLoS ONE, Apr. 21, 20i15, 10(8):e0136455.DOI:10.1371, Journal.pone.0136455.
Mucientes, A. et al., Specific association of IL17A genetic variants with panuveitis. (2015) Br J Ophthalmol. 99(4):566-70.
Mukai et al., SH3BP2 Gain-Of-Function Mutation Exacerbates Inflammation and Bone Loss in a Murine Collagen-Induced Arthritis Model, 2014 PLoS ONE 9(8): 6105518.
Mulder et al. 'Environmentally-acquired bacteria influence microbial diversity and natural innate immune responses at gut surfaces'. Bmc Biology. 2009, vol. 7, No. 1, p. 79.
Murofushi, Y., Villena, J., Morie, K., Kanmani, P., Tohno, M., Shimazu, T., et al. (2015). The toll-like receptor family protein RP105/MD1 complex is involved in the immunoregulatory effect of exopolysaccharides from Lactobacillus plantarum N14. Mol Immunol 64(1), 63-75. doi: 10.1016/j.molimm.2014.10.027.
Narushima, et al., Characterization of the 17 strains of regulatory T cell-inducing human-derived Clostridia. Gut Microbes Mar. 18, 2014; 5:3, 333-339.
Naughton PJ; Grant G. (2005) Modelling of salmonellosis In: Microbial Ecology of the Growing Animal Holzapfel WH, Naughton PJ. (Eds). London, Elsevier, pp. 235-257.
NCBI Reference Sequence: NR_026314.1, Blautia hydrogenolrophica strain S5a36 16S ribosomal RNA gene, partial sequence (Feb. 3, 2015), 3 pages.
Neeser, J.R., et al., Lactobacillus johnsonii Lal shares carbohydrate-binding specificities with several enteropathogenic bacteria (2000). Glycobiology, 10 (II), pp. II93-II99.
Neish et al., TLRS in the Gut. II. Flagellin-induced inftammation and antiapoptosis, American Journal of Physiology-Gastrointestinal and Liver Physiology. 2007;292:G462-466.
Neish, A. S. et al., Prokaryotic Regulation of Epithelial Responses by Inhibition of IκB-α Ubiquitination. Science 289, 1560 (2000).
Nemeth et al. 'Inhibition of *Salmonella*-induced IL-8 synthesis and expression of Hsp70 in enterocyte-like Caco-2 cells after exposure to non-starter lactobacilli'. International Journal of Food Microbiology. 2006, vol. 112, No. 3, pp. 266-274.
Neville, B.A., Functional genomics of motile commensal intestinal bacteria. PhD Thesis. University College Cork. 2013. 281 Pages.
Neville, et al., Characterization of pro-inflammatory flagellin proteins produced by Lactobacillus ruminis and related motile Lactobacilli. PloS one. Jul. 2012;7(7):e40592.
Neyrinck et al. 'Dietary modulation of clostridial cluster XlVa gut bacteria (*Roseburia* spp.) by chitin-glucan fiber improves host metabolic alterations induced by high-fat diet in mice.' The Journal of Nutritional Biochemistry. 2012, vol. 23, No. 1, pp. 51-59.

(56) References Cited

OTHER PUBLICATIONS

Ng et al., Archaeal flagella, bacterial flagella and type IV pili: a comparison of genes and posttranslation modification, Journal of Molecular Microbiology and Biotechnology. 2006;11:167-191.
Nicolau, D.P. Current challenges in the management of the infected patient (20II). Current Opinion in Infectious Diseases, 24 (Suppll), pp. SI-S10.
Non-Final Office Action dated Oct. 8, 2019 for U.S. Appl. No. 16/265,238.
Non-Final Office Action dated Oct. 9, 2019 for U.S. Appl. No. 15/969,543.
Notice of Allowance dated Feb. 3, 2016 for U.S. Appl. No. 14/349,907.
Notice of Allowance dated Mar. 6, 2017 for U.S. Appl. No. 14/249,710.
Notice of Allowance dated Mar. 30, 2011 for U.S. Appl. No. 10/285,224.
Notice of Allowance dated Apr. 25, 2016 for U.S. Appl. No. 14/232,475.
Notice of allowance dated Jun. 16, 2017 for U.S. Appl. No. 14/249,710.
Notice of Allowance dated Aug. 23, 2016 for U.S. Appl. No. 14/232,475.
Notice of allowance dated Sep. 1, 2017 for U.S. Appl. No. 15/357,850.
Notice of allowance dated Sep. 6, 2017 for U.S. Appl. No. 14/249,710.
Notice of Allowance dated Nov. 17, 2016 for U.S. Appl. No. 14/249,710.
Notice of Allowance dated Nov. 22, 2017 for U.S. Appl. No. 15/359,988.
Notice of Allowance dated Nov. 24, 2017 for U.S. Appl. No. 15/070,605.
Notice of Publication dated Dec. 27, 2018 for U.S. Appl. No. 16/022,256.
Nuala Moran: 'Microbial wealth', chemistry and industry, 78(6), Jun. 1, 2014, pp. 20-23, XP055252922.
Numasaki, M. et al., IL-17 Enhances the Net Angiogenic Activity and In Vivo Growth of Human Non-Small Cell Lung Cancer in SCID Mice through Promoting CXCR-2-Dependent Angiogenesis. (2005) J. Immunol. 175: 6177-6189.
Numasaki, M. et al., Interleukin-17 promotes angiogenesis and tumor growth. Blood. Apr. 1, 2003;101(7):2620-7. Epub Oct. 31, 2002.
Nutsch et al., T cell tolerance and immunity to commensal bacteria. Current Opinion in Immunology. Aug. 2012; 24 (4):385-391.
O'Connell Motherway, M., Kinsella, M., Fitzgerald, G.F., and Sinderen, D. (2013). Transcriptional and functional characterization of genetic elements involved in galacto-oligosaccharide utilization by Bifidobacterium breve UCC2003. Microbial biotechnology 6(1), 67-79. doi: 10.1111/1751-7915.12011.
O'Connell Motherway, M., O'Driscoll, J., Fitzgerald Gerald, F., and Van Sinderen, D. (2009). Overcoming the restriction barrier to plasmid transformation and targeted mutagenesis in Bifidobacterium breve UCC2003. Microbial Biotechnology 2(3), 321-332. doi: 10.1111/j.1751-7915.2008.00071.x.
O'Connell Motherway, M., Zomer, A., Leahy, S.C., Reunanen, J., Bottacini, F., Claesson, M.J., et al. (2011). Functional genome analysis of Bifidobacterium breve UCC2003 reveals type IVb tight adherence (Tad) pili as an essential and conserved host-colonization factor. Proc Natl Acad Sci U S A 108(27), 11217-11222. doi: 10.1073/pnas.1105380108.
Odamaki, Toshitaka et al., "Age-related changes in gut microbiota composition from newborn to centenarian: a cross-sectional study," BMC Microbiology (2016) 16:90, pp. 1-12, DOI 10.1186/S12866-016-0708-5.
Odile Menard et al, "Gnotobiotic Mouse Immune Response Induced by Bifidobacterium sp. Strains Isolated from Infants", Applied and Environmental Microbiology, Feb. 2008, p. 660-666.
Office Action dated Jan. 2, 2018 for U.S. Appl. No. 15/357,936.
Office Action dated Jan. 11, 2005 for U.S. Appl. No. 10/285,224.
Office Action dated Jan. 26, 2009 for U.S. Appl. No. 10/275,706.
Office Action dated Feb. 18, 2010 for U.S. Appl. No. 10/285,224.
Office Action dated Mar. 13, 2013 for U.S. Appl. No. 12/760,926.
Office Action dated Mar. 26, 2007 for U.S. Appl. No. 10/275,706.
Office Action dated Apr. 4, 2008 for U.S. Appl. No. 10/285,224.
Office Action dated May 2, 2007 for U.S. Appl. No. 10/285,224.
Office Action dated May 2, 2008 for U.S. Appl. No. 10/275,706.
Office Action dated May 25, 2016 for U.S. Appl. No. 14/249,710.
Office Action dated May 26, 2009 for U.S. Appl. No. 10/285,224.
Office Action dated May 26, 2017 for U.S. Appl. No. 15/357,850.
Office Action dated May 30, 2006 for U.S. Appl. No. 10/285,224.
Office Action dated Jun. 26, 2017 for U.S. Appl. No. 15/357,936.
Office Action dated Jul. 6, 2017 for U.S. Appl. No. 15/070,605.
Office action dated Jul. 8, 2015 for U.S. Appl. No. 14/349,907.
Office Action dated Jul. 31, 2017 for U.S. Appl. No. 15/359,988.
Office Action dated Aug. 10, 2017 for U.S. Appl. No. 15/357,850.
Office Action dated Aug. 21, 2013 for U.S. Appl. No. 12/760,926.
Office Action dated Sep. 4, 2015 for U.S. Appl. No. 14/249,710.
Office Action dated Sep. 17, 2010 for U.S. Appl. No. 10/285,224.
Office Action dated Oct. 12, 2005 for U.S. Appl. No. 10/285,224.
Office Action dated Oct. 28, 2009 for U.S. Appl. No. 10/275,706.
Office Action dated Oct. 30, 2008 for U.S. Appl. No. 10/285,224.
Office Action dated Nov. 2, 2017 for U.S. Appl. No. 15/700,007.
Office Action dated Nov. 6, 2006 for U.S. Appl. No. 10/285,224.
Office Action dated Nov. 23, 2015 for U.S. Appl. No. 14/232,475.
Office Action dated Nov. 24, 2017 for U.S. Appl. No. 15/359,972.
Office Action dated Nov. 24, 2017 for U.S. Appl. No. 15/679,857.
Office Action dated Dec. 6, 2017 for U.S. Appl. No. 15/592,178.
Office Action dated Dec. 13, 2012 for U.S. Appl. No. 12/760,926.
Office Action dated Dec. 19, 2005 for U.S. Appl. No. 10/275,706.
Office Action dated Mar. 19, 2019 for U.S. Appl. No. 16/031,024.
Ohashi, Y., Ushida, K. Health-beneficial effects ofprobiotics: Its mode of action (2009). Animal Science Journal, 80 (4), pp. 361-371.
Oladipo, et al., Bioprotective potential of bacteriocinogenic enterococcus gallinarum strains isolated from some Nigerian fermented foods, and of their bacteriocins. Polish Journal of Microbiology. 2014; 63(4): 415-422.
Olivares, M., Castillejo, G., Varea, V., and Sanz, Y. (2014). Double-blind, randomised, placebo-controlled intervention trial to evaluate the effects of Bifidobacterium longum CECT 7347 in children with newly diagnosed coeliac disease. British Journal of Nutrition 112(1), 30-40. doi: 10.1017/S0007114514000609.
Olivera et al. 'Nutritional and physiological responses of young growing rats to diets containing raw cowpea seed meal, protein isolate (globulins), or starch.' Journal of agricultural and food chemistry. 2003, vol. 51, No. 1, pp. 319-325.
O'Sullivan et al., "Bacterial Supplementation in the Irritable Bowel Syndrome. A Randomised Double-Blind Placebo-Controlled Crossover Study", Digest Liver Dis. 2000. pp. 294-301.
Overbeek, R., Begley, T., Butler, R.M., Choudhuri, J.V., Chuang, H.-Y., Cohoon, M., et al. (2005). The Subsystems Approach to Genome Annotation and its Use in the Project to Annotate 1000 Genomes. Nucleic Acids Research 33(17), 5691-5702. doi: 10.1093/nar/gki866.
Overstreet et al. 'Dysbiosis Characterized by Reduced Abundance of Roseburia is Associated With Increased Severity of Colitis in IL-10-/- Mice'. Gastroenterology. 2011, vol. 140, No. 5, Suppl. 1, pp. S-696.
Pace et al. Macrophage activiation: Priming activity from a T-cell hybridoma is attributable to interferon. (1983) PNAS. 80:3782-6.
Pang, et al., Crystal structure of human pirin: an iron-binding nuclear protein and transcription cofactor. Journal of Biological Chemistry, 279(2); Jan. 9, 2004:1491-1498.
Parabacteroides distasonis (Eggerth and Gagnon) Sakamoto and Benno (ATCC 8503). Sep. 19, 2017. 2 Pages.
Parfenov A.I., "Pain syndrome in the practice of a gastroenterologist", "Breast Cancer" No. 0 from Jan. 25, 2008, 5 pages, https://www.rmj.ru/articles/bolevoy_sindrom/Bolevoy_sindrom_v_praktike_gastroenterologa/.
Park, S.K. et al., Blautia stercoris sp. nov., isolated from human faeces. International journal of systematic and evolutionary microbiology. 2012; 62(4): 776-779.

(56) References Cited

OTHER PUBLICATIONS

Patel., R. et al., Determination of 16S rRNA sequences of enterococci and application to species identification of nonmotile enterococcus gallinarum isolates. Journal of clinical microbiology, 1998; 36(11):3399-3407.
Paustian, C., Taylor, P., Johnson, T., Xu, M., Ramirez, N., Rosenthal, K.S., et al. (2013). Extracellular ATP and Toll-like receptor 2 agonists trigger in human monocytes an activation program that favors T helper 17. PLoS One 8(1), e54804. doi: 10.1371/Journal.pone.0054804.
PCR (Introduction to Biotechniques Series), 2nd ed. (Newton & Graham eds., 1997, Springer Verlag).
PCT/EP2017/025038 International Preliminary Report on Patentability dated Jun. 6, 2018, 8 Pages.
PCT/EP2017/025038 International Search Report and Written Report dated Jun. 12, 2017.
PCT/EP2017/025038 Written Opinion of the International Preliminary Examining Authority dated Jan. 1, 2018.
PCT/EP2017/025038 Written Opinion of the International Preliminary Examining Authority dated Jan. 25, 2018.
PCT/GB2017/052076 Written Opinion of the International Preliminary Examining Authority dated Jun. 21, 2018, 11 Pages.
PCT/GB2017/052077 International Search Report dated Oct. 16, 2017.
PCT/GB2017/052077 Written Opinion dated Oct. 16, 2017.
PCT/GB2017/052077 Written Opinion of the International Preliminary Examining Authority dated Jun. 21, 2018, 10 Pages.
Pearson, WR. An introduction to sequence similarity ("Homology") searching. Current protocols in bioinformatics/editoral board, Andreas D Baxevanis. [et al], 2013; 0 3:10. 1002/0471250953.bi0301s42. doi:10.1002/0471250953.bi0301s42.
Pedro Berraondo et al., "Cytokines in clinical cancer immunotherapy", British Journal of Cancer, 2019, 120:6-15.
Petersen et al. Intestinal colonization with phylogenetic group B2 *Escherichia coli* related to inflammatory bowel disease: a systematic review and meta-analysis. 2015. Scand J Gastroenterol.;50(10):1199-207.
Peterson et al. 'Catecholamines increase conjugative gene transfer between enteric bacteria.' Microbial Pathogensis. 2011, vol. 51, No. 1, pp. 1-8.
Petsuriyawong et al. 'Screening of probiotic lactic acid bacteria from piglet feces'. Nature Science. 2011, vol. 45, pp. 245-253.
Ping Dong et al., "The role of intestinal bifidobacteria on immune system development in young rats", Early Human Development 86 (2010) 51-58.
Pinto-Sánchez, M.I., Smecuol, E.C., Temprano, M.P., Sugai, E., González, A., Moreno, M.L., et al. (2017). Bifidobacterium infantis NLS Super Strain Reduces the Expression of α-Defensin-5, a Marker of Innate Immunity, in the Mucosa of Active Celiac Disease Patients. Journal of Clinical Gastroenterology 51(9), 814-817. doi: 10.1097/mcg.0000000000000687.
Polak J.M. and McGee J.O., In Situ Hybridization: Principles and Practice, Oxford University Press. 1990; pp. vii-viii.
Potrykus (1991) "Gene Transfer to Plants: Assessment of Published Approaches and Results," Annu. Rev. Plant Physiol. Plant Mol. Biol. 42:205-225.
Prakash, et al., Complete genome sequences of rat and mouse segmented filamentous bacteria, a potent inducer of th17 cell differentiation. Cell Host & Microbe. Sep. 2011;10(3):273-284.
Pryde et al. 'The microbiology of butyrate formation in the human colon.' FEMS Microbiology Letters. 2002. vol. 217,No. 2, pp. 133-139.
Punt et al. (2002) "Filamentous fungi as cell factories for heterologous protein production," Trends Biotechnol. 20 (5):200-206.
Qin et al. 'A human gut microbial gene catalogue established by metagenomic sequencing.' Nature. 2010, vol. 464, No. 7285, pp. 59-65.
Rajilic-Stojanovic, et al. The first 1000 cultures species of the human gastrointestinal micriobiota. FEMS MIcriobiol Rev, vol. 38, 2014. pp. 996-1047.

Reddy, K.B.P.K., et al., Role of cryoprotectants on the viability and functional properties of pro biotic lactic acid bacteria during freeze drying (2009). Food Biotechnology, 23 (3), pp. 243-265.
Reiff,C. and Kelly,D.,Inflammatory bowel disease, gut bacteria and probiotic therapy. International journal of medical microbiology, 2010;300:25-33.
Reuter, G. (2001). The Lactobacillus and Bifidobacterium microflora of the human intestine: composition and succession. Current Issues in Intestinal Microbiology 2(2), 43-53.
Rhee et al.,Toll-Like Receptor 5 Engagement Modulates Tumor Development and Growth in a Mouse Xenograft Model of Human Colon Cancer. Gastroenterology. Aug. 2008;135(2):518-528.
Rhee, Young-Kyung et al.., Antihumor Activity of *Bifidobacterium* Spp. isolated from a healthy Korean, Arch Pharm Res vol. 23, No. t, 482-487 2000.
Riquelme. Will 4D Pharma be UK's next Microbiome leader? Feb. 2, 2015, LABIOTECH.eu [online].
Robertson, J.M.C., et al., Lack of flagella disadvantages *Salmonella enterica* serovar Enteritidis during the early stages of infection in the rat (2003). Journal of Medical Microbiology, 52 (1), pp. 91-99.
Robinson, et al. Inside information—The unique features of visceral sensation. 2008. Mol Interv, 8(5): 242-253.
Rockwell, S.C. et al., Characteristics of a Serially Transplanted Mouse Mammary Tumor and Its Tissue-Culture-Adapted Derivative. (1972) J Natl Cancer Inst. 49:735-49.
Roe, et al., DNA Isolation and Sequencing: Essential Techniques. John Wiley & Sons, New York, New York. 1996; pp. v-vii.
Rong, Y., Dong, Z., Hong, Z., Jin, Y., Zhang, W., Zhang, B., et al. (2017). Reactivity toward Bifidobacterium longum and Enterococcus hirae demonstrate robust CD8(+) T cell response and better prognosis in HBV-related hepatocellular carcinoma. Experimental Cell Research 358(2), 352-359. doi: 10.1016/j.yexcr.2017.07.009.
Roseburia. Ubiome, 2018. Accessed on Jun. 25, 2018; Available at: https://shop.ubiome.com/pages/roseburia-1.
Round et al. 'The Toll-like receptor 2 pathway establishes colonization by a commensal of the human microbiota.' Science. 2011, vol. 332, No. 6032, pp. 974-977.
Rudinger J, "Characteristics of the amino acids as components of a peptide hormone sequence," Peptide Hormones, JA Parsons Edition, University Park Press, Jun. 1976, pp. 1-7.
Ruiz, L., Delgado, S., Ruas-Madiedo, P., Margolles, A., and Sanchez, B. (2016). Proteinaceous Molecules Mediating Bifidobacterium-Host Interactions. Front Microbiol 7, 1193. doi: 10.3389/fmicb.2016.01193.
Ruiz, P.A., Hoffmann, M., Szcesny, S., Blaut, M., and Haller, D. (2005). Innate mechanisms for Bifidobacterium lactis to activate transient pro-inflammatory host responses in intestinal epithelial cells after the colonization of germ-free rats. Immunology 115(4), 441-450. doi: 10.1111/j.1365-2567.2005.02176.x.
Russell et al. 'High-protein, reduced-carbohydrate weight-loss diets promote metabolite profiles likely to be detrimental to colonic health.' The American Journal of Clinical Nutrition. 2011, vol. 93, No. 5, pp. 1062-1072.
Sagar, et al., Bifidobacterium breve and lactobacillus rhamnosus treatment is as effective as budesonide at reducing inflammation in a murine model for chronic asthma. Respiratory Research. 2014; 15(46):1-17.
Saiki, et al., Primer-directed enzymatic amplification of DNA with a thermostable DNA polymerase. 1988. Science, 239. pp. 487-491.
Sakamato, et al., *Parabacteroides faecis* sp. nov., isolated from human faeces. International Journal of Systematic and Evolutionary Microbiology (2015), 65, 1342-1346.
Sakamoto Mitsuo et al., Reclassfication of Baceroides distasonis, Bacteroides goldsteinii and Bacteroides merdae as *Parabacteroides distasonis* gen. nov., comb, nov., Parabacteroides goldsteinii comb. nov. and Parabacteroides merdae comb, nov., International Journal of Systematic and Evolutionary Microbiology (2006) 56, 15-99-1605. DOI 10.1099/ijs.0.0641920.
Sakamoto, et al., *Parabacteroides gordonii* sp. nov., isolated from human blood cultures. International Journal of Systematic and Evolutionary Microbiology (2009), 59, 2843-2847.

(56) References Cited

OTHER PUBLICATIONS

Sakamoto, et al., *Parabacteroides johnsonii* sp. nov., isolated from human faeces. International Journal of Systematic and Evolutionary Microbiology (2007), 57, 293-296.
Sakamoto, M. et al., Reclassification of Bacteroides distasonis, Bacteroides goldsteinii and Bacteroides merdae as *Parabacteroides distasonis* gen. nov., comb, nov., Parabacteroides goldsteinii comb. nov. and Parabacteroides merdae comb. nov. International journal of systematic and evolutionary microbiology. 2006; 56:1599-1605.
Salix Pharmaceuticals, Inc. FDA Highlights of Prescribing Information—Xifaxan (rifaximin tablet). Revised Nov. 2015.
Salminen et al. 'Probiotics: how should they be defined?.' Trends in Food Science & Technology. 1999, vol. 10, No. 3, pp. 107-110.
Salonen et al., Gastrointestinal microbia in irritable bowel syndrome: present state and perspectives. Microbiology. 2010; 156: 3205-3215.
Savignac HM et al., "Bifidobacteria exert strain-specific effects on stress-related behavior and physiology in BALB/c mice.", Neurogastroenterol Motil. Nov. 2014;26(11):1615-27. doi: 10.1111/nmo.12427. Epub Sep. 24, 2014.
Scanlan PD., et al., Culture-independent analyses of temporal variation of the dominant fecal microbiota and targeted bacterial subgroups in Crohn's disease. J Clin Microbiol. Nov. 2006;44(11):3980-8. Epub Sep. 20, 2006.
Scher et al., Expansion of intestinal Prevotella copri correlates with enhanced susceptibility to arthritis. 2013; eLIFE 2, e01202, 20 Pages.
Schiavi, E., Gleinser, M., Molloy, E., Groeger, D., Frei, R., Ferstl, R., et al. (2016). The Surface-Associated Exopolysaccharide of Bifidobacterium longum 35624 Plays an Essential Role in Dampening Host Proinflammatory Responses and Repressing Local TH17 Responses. Appl Environ Microbiol 82(24), 7185-7196. doi: 10.1128/AEM.02238-16.
Schiavi, E., Plattner, S., Rodriguez-Perez, N., Barcik, W., Frei, R., Ferstl, R., et al. (2018). Exopolysaccharide from *Bifidobacterium longum* subsp. *longum* 35624 modulates murine allergic airway responses. Benef Microbes, 1-14. doi: 10.3920/BM2017.0180.
Schieck, M. et al., Genetic variation in TH17 pathway genes, childhood asthma, and total serum IgE levels.(2014) J Allergy Clin Immunol. 133(3):888-91.
Schleifer, K.H. et al., Transfer of *Streptococcus faecalis* and *Streptococcus faecium* to the Genus *Enterococcus* nom. rev. as Enterococcus faecalis comb. nov. and Enterococcus faecium comb. nov. Int J Syst Evol Microbiol, Jan. 1984 34: 31-34, doi:10.1099/00207713-34-1-31.
Schmitz, S. et al., A prospective, randomized, blinded, placebo-controlled pilot study on the effect of Enterococcus faecium on clinical activity and intestinal gene expression in canine food-responsive chronic enteropathy. J Vet Intern Med. Mar. 2015-Apr. 29(2):533-43. doi: 10.1111/jvim.12563. Epub Mar. 16, 2015.
Schouten, et al., Cow milk allergy symptoms are reduced in mice fed dietary synbiotics during oral sensitization with whey. Nutritional Immunology. 2015; 139(7):1390-403.
Schreiber, O, et al., Lactobacillus reuteri prevents colitis by reducing P-selectin-associated leukocyte- and plateletendothelial cell interactions (2009). American Journal of Physiology-Gastrointestinal and Liver Physiology, 296 (3), pp. G534-G542.
Schulke et al. (Aug. 26, 2011) "A fusion protein of flagellin and ovalbumin suppresses the 25 TH2 response and prevents murine intestinal allergy," The Journal of Allergy and Clinical Immunology. 128(6):1340-1348.
Schwiertz, et al., Quantification of Different *Eubacterium* spp. in Human Fecal Samples with Species-Specific 16S rRNA-Targeted Oligonucleotide Probes. Applied and environmental biology, vol. 66, No. 1, Jan. 1, 2000; pp. 375-382.
Scott et al. 'Substrate-driven gene expression in Roseburia inulinivorans: importance of inducible enzymes in the utilization of inulin and starch.' Proceedings of the National Academy of Sciences. 2011, vol. 108, Supp. 1, pp. 672-4679.

Scuotto, Angelo et al., In silico mining and characterization of bifidobacterial lipoprotein with CHHP domain secreted in an aggregated form, International J. of Biol. Macromolecules 82(2016), 653-662.
Sczesnak, et al., The genome of th17 cell-inducing segmented filamentous bacteria reveals extensive auxotrophy and adaptations to the intestinal environment. Cell Host Microbe. Sep. 2011;10 (3):260-272.
Severijnen, A. J. et al., Chronic Arthritis Induced in Rats by Cell Wall Fragments of Eubacterium Species from the Human Intestinal Flora. Infection and Immunity, 1990, vol. 58, No. 2, 523-528.
Severijnen, et al., Chronic Arthritis Induced in Rats by Cell Wall Fragments of Eubacterium Species from the Human Intestinal Flora. Infection and Immunity, Feb. 1990; 58(2): p. 523-528.
Sgadari et al. Mig, the Monokine Induced By Interferon-g, Promotes Tumor Necrosis In Vivo. (1997) Blood. 89:2635-43.
Sgadari, C. et al., Interferon-inducible protein-10 idenlified as a mediator of tumor necrosis in vivo. (1996) PNAS. 93:13791-6.
Shabgah, A.G. et al., Interleukin-17 in human inflammatory diseases. Postepy Dermatol Alergol. Aug. 2014; 31(4): 256-261.
Shevach et al., Current Protocols in Immunology. John Wiley & Sons. New York, New York. 1992. Table of Contents only, as accessed online at URL: http://www.4ulr.com/products/currentprotocols/immunology_toc.html. [Last Accessed Jun. 18, 2015].
Simon, et al., Peptoids: A modular approach to drug discover, Oct. 1992. PNAS, 89(20):9367-9371.
Simpson-Herren, L. et al., Kinetic parameters and growth curves for experimental tumor systems. Cancer Chemother Rep. Jun. 1970;54(3):143-74.
Sisson, G. et al., Randomised clinical trial: a liquid multi-strain probiotic vs. placebo in the irritable bowel syndrome—a 12 week double-blind study. Aliment Pharmacol Ther. 2014; 40: 51-62.
Sivan, A., Corrales, L., Hubert, N., Williams, J.B., Aquino-Michaels, K., Earley, Z.M., et al. (2015). Commensal Bifidobacterium promotes antitumor immunity and facilitates anti-PD-L1 efficacy. Science 350(6264), 1084-1089. doi: 10.1126/science.aac4255.
Sivieri, K. et al., Probiotic enterococcus faecium CRL 183 inhibit chemically induced colon cancer in male wistar rats. Eur Food Res Technol. 2008; 228:231-237.
Skolnick, et al. From genes to protein structure and function: novel applications of computational approaches in the genomic era. Trends Biotechnol. Jan. 2000;18(1):34-9. Review.
Skountzou, et al., *Salmonella* flagellins are potent adjuvants for intranasally administered whole inactivated influenza vaccine. Vaccine. May 2010; 28(24):4103-4112.
Smith and Waterman, "Comparison of biosequences", Advances in Applied Mathematics, vol. 2, Issue 4, Dec. 1981, pp. 482-489.
Smith, C.L., et al., Lactobacillus fermentum BRII and fmcto-oligosaccharide partially reduce jejunal inflammation in a model of intestinal mucositis in rats (2008). Nutrition and Cancer, 60 (6), pp. 757-767.
Smith, et al. Comparison of Biosequences. Advances in Applied Mathematics. 1981;2: 482-489.
Sokol et al. 'Faecalibacterium prausnitzii is an anti-inflammatory commensal bacterium identified by gut microbiota analysis of Crohn disease patients.' Proceedings of the National Academy of Sciences. 2008, vol. 105, No. 43, pp. 6731-16736.
Sokol et al. 'Low counts of Faecalibacterium prausnitzii in colitis microbiota.' Inflammatory bowel diseases. 2009, vol. 15, No. 8, pp. 1183-1189.
Song et al., Impact of Schistosoma japonicum Infection on Collagen-Induced Arthritis in DBA/1 Mice: A Murine Model of Human Rheumatoid Arthritis. 2011; PLoS ONE 6, e23453, 10 pAGES.
Song, Yuli et al., *Bacteroides goldsteinii* sp. nov. Isolated from Clinical Specimens of Human Intestinal Origin, J. Clinical Microbiology, Sep. 2005, p. 4522-4527. DOI: 10.1128/JCM.43.9.4522-4527.2005.
Sonnenburg, et al., Genomic and Metabolic Studies of the Impact of Probiotics on a Model Gut Symbiont and Host. PLoS Biol 4(12): e413. https://doi.org/10.1371/journal.pbio.0040413.
Spor, A. et al., Unravelling the effects of the environment and host genotype on the gut microbiome. Nat Rev Microbiol. Apr. 2011;9(4):279-90. doi: 10.1038/nrmicro2540.

(56) References Cited

OTHER PUBLICATIONS

Srutkova, D. et al., Efficiency of PCR-based methods in discriminating *Bifidobacterium longum* ssp. *longum* and *Bifidobacterium longum* ssp. *infantis* strains of human origin.J Microbiol Methods. Oct. 2011;87(1): 10-6. doi: 10.1016/j.mimet.2011.06.014. Epub Jul. 2, 2011.
Stanton et al. (1983) "Roseburia cecicolagen. nov., sp. nov., a Motile, Obligately Anaerobic Bacterium from a Mouse Cecum," Int. J. Syst. Bacterial. 33:618-627.
Stokholm, et al., Maturation of the gut microbiome and risk of asthma in childhood. Nature Communications, 2018; 9(141): 1-10.
Stoll et al., Altered microbiota associated with abnormal humoral immune responses to commensal organisms in enthesitis-related arthritis, 2014; Arthritis Res Ther. 16:486.
Strasser, S. et al., Influence of lyophilization, fluidized bed drying, addition of protectants, and storage on the viability oflactic acid bacteria (2009). Journal of Applied Microbiology, 107 (1), pp. 167-177.
Strickertsson, J.A. et al., Enterococcus faecalis Infection and Reactive Oxygen Species Down-Regulates the miR-17-92 Cluster in Gastric Adenocarcinoma Cell Culture. Genes 2014, 5(3), 726-738.
Strobel, H.J. Basic laboratory culture methods for anaerobic bacteria. Methods Mol Biol. 2009;581:247-61. doi: 10.1007/978-1-60761-214-8_16.
Strus et al. Distinct effects of Lactobacillus plantarum KL30B and *Escherichia coli* 3A1 on the induction and development of acute and chronic inflammation. 2015. Cent Eur J lmmunol.40(4):420-30.
Sudha B. Singh and Henry C. Lin, "Hydrogen Sulfide in Physiology and Diseases of the Digestive Tract", Microorganisms 2015, 3, 866-889; doi:10.3390/microorganisms3040866.
Sun, D. et al., The role of Th17-associated cytokines in the pathogenesis of experimental autoimmune uveitis (EAU). (2015) Cytokine. 74(1):76-80.
Sun, et al., Exploring gut microbes in human health and disease: Pushing the envelope. Genes Dis. Dec. 2014; 1(2):132-139.doi:10.1016/j.gendis.2014.08.001.
Supplement to: Israel, et al., Severe and difficult-to-treat asthma in adults. N Engl J Med 2017;377:965-76.
Suzanne L. Topalian et al., "Survival, Durable Tumor Remission, and Long-Term Safety in Patients With Advanced Melanoma Receiving Nivolumab", Journal of Clinical Oncology, vol. 32, No. 10, Apr. 1, 2014, pp. 1-12.
Tahoun, A., Masutani, H., El-Sharkawy, H., Gillespie, T., Honda, R.P., Kuwata, K., et al. (2017). Capsular polysaccharide inhibits adhesion of Bifidobacterium longum 105-A to enterocyte-like Caco-2 cells and phagocytosis by macrophages. Gut Pathog 9, 27. doi: 10.1186/s13099-017-0177-x.
Takashi Nakamura et al., "Evaluation of the Effects of Dietary Organic Germanium, Ge-132, and Raffinose Supplementation on Caecal Flora in Rats", Bioscience of Microbiota, Food and Health vol. 31 (2), 37-45, 2012.
Tamanai-Shacoori, et al., *Roseburia* spp.: a marker of health?. Future Microbiology Review 12(2), 157-170 (2017).
Tan, Hai-Qin et al., *Parabacteroides chartae* sp. nov., an obligately anaerobic species from wastewater of a paper mill, International Journal of systematic and Evolutionary Microbiology (2012), 62-2613-2617, DOI 10.1099/ijs.0.038000-0.
Tanaka, K. and Watanabe, K., In Vitro tebipenem activity against anaerobic bacteria. Japanese Journal of Chemotherapy. Mar. 2009. vol. 57 S-1.
Tap et al. Towards the human intestinal microbiota phylogenetic core. 2009. Environ Microbiol, 11(10):2574-84.
Tatusova et al. (1999) "BLAST 2 Sequences, a new tool for comparing protein and nucleotide sequences," FEMS Microbial. Lett. 174(2):247-250.
Tatusova et al., BLAST 2 Sequences, a new tool for comparing protein and nucleotidesequences, FEMS Microbiology Letters 174 (1999) 247-250.
Tatusova et al., Erralum to BLAST 2 Sequences, a new tool for comparing protein and nucleotide sequences, FEMS Microbiology Letters 177 (1999) 187-188.
Tatusova, et al., Erratum to BLAST 2 Sequences, a new tool for comparing protein and nucleotide sequences [FEMS Microbiol. 174 (1999) 247-250], FEMS Microbial. Lett. 1999;177(1):187-188.
Teng, L. J. et al., PCR Assay for Species-Specific Identification ofBacteroides thetaiotaomicron. J Clin Microbiol38, 1672-1675 (2000).
Terciz, Janos et al., Inflammation and Colon Cancer, Gastroenterology, 2010: 138: 2101-2114.
Tesmer, LA. et al., Th17 cells in human disease. Immunol Rev. 2008;223:87-113.
Tilg, et al., Roseburia hominis: a novel guilty player in ulcerative colitis pathogenesis? Gut, Oct. 14, 2013;63(8)1204-1205.
Tomas, M.S.J., et al., Stability of freeze-dried vaginal Lactobacillus strains in the presence of different lyoprotectors (2009). Canadian Journal of Microbiology, 55 (5), pp. 544-552.
Tomosada, Y., Villena, J., Murata, K., Chiba, E., Shimazu, T., Aso, H., et al. (2013). Immunoregulatory Effect of Bifidobacteria Strains in Porcine Intestinal Epithelial Cells through Modulation of Ubiquitin-Editing Enzyme A20 Expression. PLOS ONE 8(3), e59259. doi: 10.1371/journal.pone.0059259.
Toomer, O. et al., Maternal and postnatal dietary probiotic supplementation enhances splenic regulatory T helper cell population and reduces peanut allergen-induced hypersensitivity responses in mice. Immunobiology. 209; 2014: 661-670.
Travis, et al. Complete genome sequence of the human gut symbiont Roseburia hominis. Genome announcements. 2015; 3(6):e01286-15.
Tremaroli, et al., A role for the gut microbiota in energy harvesting? Gut. Dec. 2010; 59(12):1589-1590.
Trueman (1995) "Heterologous Expression in Yeast," Methods Molecular Biology. 49:341-354.
Tsukinowa, et al., Fecal microbiota of a dugong (*Dugong dugong*) in captivity at Toba Aquarium. J. Gen. Appl. Microbiol., 54, 25-38 (2008).
Turnbaugh et al. A core gut microbiome in obese and lean twins. Jan. 22, 2009. Nature, 457(7228): 480-484.
Turnbaugh et al., Diet-induced obesity is linked to marked but reversible alterations in the mouse distal gut microbiome. Cell Host & Microbe. Apr. 2008;3(4):213-223.
Turnbaugh, et al., An obesity-associated gut microbiome with increased capacity for energy harvest. Nature. Dec. 2006;444(7122):1027-1031.
Turner (1994) "Vectors for genetic manipulation," In; Martinelli, S.D.; Kinghorn J. R.: Eds. Aspergillus: 50 years on. Progress in industrial microbiology. vol. 29. Elsevier. Amsterdam, The Netherlands, pp. 641-666.
Turroni, F., Taverniti V Fau—Ruas-Madiedo, P., Ruas-Madiedo P Fau—Duranti, S., Duranti S Fau—Guglielmetti, S., Guglielmetti S Fau—Lugli, G.A., Lugli Ga Fau—Gioiosa, L., et al. (2014). Bifidobacterium bifidum PRL2010 modulates the host innate immune response. Appl Environ Microbiol 80(1098-5336 (Electronic)), 730-740.
Tzortzis, G., et al., Modulation of anti-pathogenic activity in canine-derived Lactobacillus species by carbohydrate growth substrate (2004). Journal of Applied Microbiology, 96 (3), pp. 552-559.
U.S. Appl. No. 15/357,936 Notice of Allowance dated Apr. 18, 2018.
U.S. Appl. No. 15/359,144 Notice of Allowance dated Sep. 4, 2018.
U.S. Appl. No. 15/359,972 Notice of Allowance dated Aug. 8, 2018.
U.S. Appl. No. 15/359,988 Notice of Allowance dated Mar. 2, 2018.
U.S. Appl. No. 15/359,988 Notice of Allowance dated Mar. 16, 2018.
U.S. Appl. No. 15/592,178 Notice of Allowance dated Apr. 12, 2018.
U.S. Appl. No. 15/592,178 Notice of Allowance dated Jul. 12, 2018.
U.S. Appl. No. 15/631,945 Notice of Allowance dated Oct. 18, 2018.
U.S. Appl. No. 15/700,007 Notice of Allowance dated Oct. 17, 2018.

(56) References Cited

OTHER PUBLICATIONS

U.S. Appl. No. 15/915,885 Notice of Allowance dated May 23, 2018.
U.S. Appl. No. 15/915,889 Notice of Allowance dated Jun. 4, 2018.
U.S. Appl. No. 15/916,167 Notice of Allowance dated May 31, 2018.
U.S. Appl. No. 15/916,202 Notice of Allowance dated Jun. 11, 2018.
U.S. Appl. No. 15/916,205 Notice of Allowance dated May 30, 2018.
U.S. Appl. No. 15/359,144 Office Action dated Apr. 10, 2018.
U.S. Appl. No. 15/359,972 Office Action dated Apr. 4, 2018.
U.S. Appl. No. 15/431,393 Office Action dated Jul. 30, 2018.
U.S. Appl. No. 15/631,945 Office Action dated Jul. 5, 2018.
U.S. Appl. No. 15/631,945 Office Action dated May 15, 2018.
U.S. Appl. No. 15/631,952 Office Action dated Feb. 16, 2018.
U.S. Appl. No. 15/631,952 Office Action dated Jul. 19, 2018.
U.S. Appl. No. 15/673,270 Office Action dated Apr. 10, 2018.
U.S. Appl. No. 15/679,857 Office Action dated Aug. 6, 2018.
U.S. Appl. No. 15/679,857 Office Action dated Feb. 14, 2018.
U.S. Appl. No. 15/700,007 Non-Final Office Action dated Jun. 10, 2019.
U.S. Appl. No. 15/700,007 Office Action dated Jun. 1, 2018.
U.S. Appl. No. 15/704,245 Non-Final Office Action dated Jul. 3, 2019.
U.S. Appl. No. 15/704,245 Office Action dated Sep. 17, 2018.
U.S. Appl. No. 15/803,723 Notice of Allowance dated Feb. 13, 2018.
U.S. Appl. No. 15/842,635 Office Action dated Aug. 27, 2018.
Udayappan et al., PS4—5. Administration of Eubacterium hallii improves insulin sensitivity and degree of liversteatosis in male db/db mice. Nederlands tijdschrif voor diabetologie, vol. 11, No. 4., Nov. 23, 2013.pp. 145.
Udayappan, et al., Oral treatment with Eubacterium hallii improves insulin sensitivity in db/db mice. NPJ Biofilms and microbiomes, vol. 2, Jul. 6, 2016; p. 16009.
Ukena, et al., Probiotic *Escherichia coli* Nissle 1917 inhibits leaky gut by enhancing mucosal integrity, PloS one. Dec. 2007;2(12):e1308.
Untergasser, A., Nijveen, H., Rao, X., Bisseling, T., Geurts, R., and Leunissen, J.A. (2007). Primer3Plus, an enhanced web interface to Primer3. Nucleic Acids Res 35(Web Server issue), W71-74. doi: 10.1093/nar/gkm306.
Untergasser, et al., Primer3Plus, an enhanced web interface to Primer3, Nucleic Acids Res. 2007;35(Web Server issue):W71-W74.
U.S. Appl. No. 15/842,635 Non-Final Office Action dated May 29, 2019.
U.S. Appl. No. 16/022,577 Non-Final Office Action dated Jul. 9, 2019.
Van De Bogert, et al., Immunomodulatory properties of *Streptococcus* and veillonella isolates from the human small intestine microbiota, PLOS One, Dec. 2014: 1-20, DOI:10.1371/journal.pone. 0114277.
Van de Pol, M.A et al., Sybiotics reduce allergen-induced T-helper 2 respond and improve peak expiatory flow in allergic asthmatics, Allergy 2011;66:39-47.
Van De Veerdonk, et al., The Anti-CD20 antibody rituximab reduces the Th17 cell response. Arthritis & Rheumatism. Jun. 2011; 63(6):1507-1516.
Van Immerseel et al. 'Butyric acid-producing anaerobic bacteria as a novel probiotic treatment approach for inflammatory bowel disease.' Journal of medical microbiology. 2010, vol. 59, No. 2, pp. 141-143.
Van Nevel et al., "Control of Rumen Methanogenesis." Environmental Monitoring and Assessment, vol. 42, 1996, p. 73097, XP000979267.
Van Tilburg, M. Can we treat visceral hypersensitivity in functional abdominal pain? Lancet Gastroenterolhepatol, 2017; 2 Pages.
Verheijden, K.A.T. et al., The development of allergic inflammation in a murine house dust mite asthma is suppressed by symbiotic mixtures of non-digestible oligosaccharides and Bifidobacterium breve M-16V; Eur. J. Nut. (2016) 55: 1141-1151, DOI 10.1007, 500492-015-0928-8.
Vetrovsky, T. and Baldrian, P., The variability of the 16S rRNA gene in bacterial genomes and its consequences for bacterial community analyses. Plos One. Feb. 2013; 8(2): 657923.
Viaud, Sophie et al. "The intestinal microbiota modulates the anticancer immune effects of cyclophosphamide." Science (New York, N.Y.) vol. 342,6161 (2013): 971-6. doi:10.1126/science. 1240537.
Vijay-Kumar et al., Flagellin Treatment Protects against Chemicals, Bacteria, Viruses, and Radiation. The Journal of Immunology. 2008;180(12):8280-8285.
Vijay-Kumar, et al., Deletion of TLR5 results in 10 spontaneous colitis in mice. The Journal of Clinical Investigation. Dec. 2007;117(12):3909-3921.
Walker et al. 'Dominant and diet-responsive groups of bacteria within the human colonic microbiota.' The ISME Journal. 2010, vol. 5, No. 2, pp. 220-230.
Wang et al. 16S rRNA gene-based analysis of fecal microbiota from preterm infants with and without necrotizing enterocolitis. 2009. ISME J. 3(8): 944-954.
Wang W., Lyophilization and development of solid protein pharmaceuticals. International J. Pharmaceutics 203: 1-60, 2000.
Wang, Chun-Sai-Er, et al., VSL#3 can prevent ulcerative colitis-associated carcinogenesis in mice, Oct. 7, 2018, vol. 24, Issue 37, pp. 4254-4262.
Wang, Feng, Bifidobacterium can mitigate intestinal immunopathology in the context of CTLA-4 blockade, PNA, Jan. 2, 2018 vol. 115, No. 1, pp. 157-161.
Wang, G., Xia, Y., Cui, J., Gu, Z., Song, Y., Q., C.Y., et al. (2014). The Roles of Moonlighting Proteins in Bacteria. Current Issues in Molecular Biology 16, 15-22.
Wang, R.F., and Kushner, S.R. (1991). Construction of versatile low-copy-number vectors for cloning, sequencing and gene expression in *Escherichia coli*. Gene 100, 195-199. doi: https://doi.oig/10.1016/0378-1119(91)90366-J.
Watson, et al., Signal transduction in Campylobacter jejuni-induced cytokine production. Cellular Microbiology. 2005;7(5):655-665.
Wei, X., Yan, X., Chen, X., Yang, Z., Li, H., Zou, D., et al. (2014). Proteomic analysis of the interaction of Bifidobacterium longum NCC2705 with the intestine cells Caco-2 and identification of plasminogen receptors. J Proteomics 108, 89-98. doi: 10.1016/j.jprot.2014.04.038.
Weigel, et al., Comparative analysis of murine marrow-derived dendritic cells generated by Flt3L or GMCSF/IL-4 and matured with immune stimulatory agents on the in vivo induction of antileukemia responses. Blood. Dec. 2002;100(12):4169-4176.
Welman, A.D., and Maddox, I.S. (2003). Exopolysaccharides from lactic acid bacteria: perspectives and challenges. Trends in Biotechnology 21(6), 269-274. doi: https://doi.org/10.1016/S0167-7799(03)00107-0.
Wendler, et al., Identification of a pirin, a novel highly conserved nuclear protein. J. Biol Chem. Mar. 28, 1997; 272(13):8482-9.
Wenzel, S.E., Asthma phenotypes: the evolution from clinical to molecular approaches, Nature medicine, May 2012; 18(5):716-725.
Werth, et al., The transcription factor grainyhead-like 2 regulates the molecular composition of the epithelial apical junctional complex. Development. 2010;37(22):3835-3845.
Westermann, C., Gleinser, M., Corr, S.C., and Riedel, C.U. (2016). A Critical Evaluation of Bifidobacterial Adhesion to the Host Tissue. Front Microbiol 7, 1220. doi: 10.3389/fmicb.2016.01220.
Williams, N.T. Probiotics (2010). American Journal of Health-System Pharmacy, 67 (6), pp. 449-458.
Wilson, et al., The TLR5 ligand flagellin promotes asthma by priming allergic responses to indoor allergens. Nature Medicine. Nov. 2012;18(11):1705-1710.
Workman et al. Guidelines for the welfare and use of animals in cancer research (2010) Br. J. Cancer. 102:1555-77.
Written Opinion for PCT/US17/066709 (Published as WO2018112363) owned by Evelo Biosciences, Inc.
Written Opinion for PCT/US2017/066709 (Published as WO2018/112365) owned by Evelo Biosciences, Inc.

(56) References Cited

OTHER PUBLICATIONS

Wrzosek, et al., Bacteroides thetaiotaomicron and Faecalibacterium prausnitzii influence the production of mucus glycans and the development of globlet cells in the colonic epithelium of a gnotobiotic model rodent. BMC biology, 2013;11(61):1-13.

Wunderlich, P.F et al., Double-blind report on the efficacy of lactic acid-producing enterococcus SF68 in the prevention of antibiotic-associated diarrhoea and in the treatment of acute diarrhoea. The Journal of international medical research. 1989; 17: 333-338.

Xie et al. Short communication: Modulation of the small intestinal microbial community composition over short-term or long-term administration with Lactobacillus plantarum ZDY2013. 2016. Journal Dairy Sci. 99:6913-6921.

Xu, et al., A genomic view of the human-Bacteroides thetaiotaomicron symbiosis. Science. Mar. 28, 2003; 299(5615):2074-6.

Xu, et al., Differential development of murine dendritic cells by GM-CSF versus Flt3 ligand has implications for inflammation and trafficking. J. Immunology. 2007;179(11):7577-7584.

Xu, et al., The endogenous hydrogen sulfide producing enzyme cystathionine-i synthase contributes to visceral hypersensitivity in a rat model of irritable bowel syndrome. Molecular Pain, Biomed central, London, GB. Aug. 6, 2009; 5(1):p. 44.

Xu, J. et al., "Message from a human gut symbiont: sensitivity is a prerequisite for sharing", Trends in microbiology, 12(1), Jan. 1, 2004: pp. 21-28, XP055253932.

Yang, Changa et al., Non-invasive imaging of toll-like receptor 5 expressing using 131 labelled mAb in the mice bearing H22 tumors, Oncol. Lett. 2014., 7(6). 1919-1924., Published online Apr. 2014. i12. DOI: 10.3892/01.2014.2025.

Yang, J. et al., Targeting Th17 cells in autoimmune diseases. Trends Pharmacol Sci. Oct. 2014;35(10):493-500. doi: 10.1016/j.tips.2014. 07.006. Epub Aug. 14, 2014.

Yao, W., et al., Cultivation-Independent Analysis of the Development of the *Lactobacillus* spp. Community in the Intestinal TractofNewbornPiglets (20II)Agricultural Sciences in China, 10 (3), pp. 438-447.

Ye, X. et al., The Role of IL-23/Th17 Pathway in Patients with Primary Immune Thrombocytopenia. (2015) PLoS One. 10(1):e0117704.

Yin, X. et al., Combined effect of five single nucleotide polymorphisms related to IL23/Th17 pathway in the risk of psoriasis. Immunogenetics. Mar. 2014;66(3):215-8. doi: 10.1007/S00251-013-0756-z. Epub Jan. 14, 2014.

Yoon, et al., Structural basis of TLR5-flagellin recognition and signaling. Science. Feb. 2012; 335(6070):859-864.

Yoshinori Kohwi et al., "Antitumor Effect of Bifidobacterium Infant's in Mice", Gann, 69, 613-618; Oct. 1978.

Yq et al. Therapeutic Modulation of the Gut Microbiota in IBD—More Questions to Be Answered. (2016). J. Dig. Dis., Oct. 15, 1751-2980, 12422, Epub ahead of print.

Yu, Dah-Shyong et al., Bacille Calmette-Guerin can induce cellular apoptosis of urothelial cancer directly through toll-like receptor 7 activation, Kaohsiung Journal of Medical Sciences (2015) 31,391-397.

Yu, et al., Utilization of major fucosylated and sialylated human milk oligosaccharides by isolated human gut microbes. Glycobiology, 2013; 23(11):1281-1292.

Yu, N.Y., Wagner, J.R., Laird, M.R., Meili, G., Rey, S., Lo, R., et al. (2010a). PSORTb 3.0: improved protein subcellular localization prediction with refined localization subcategories and predictive capabilities for all prokaryotes. Bioinformatics 26(13), 1608-1615. doi: 10.1093/bioinformatics/btq249.

Yun, J.H., et al., Isolation and characterization of potential pro biotic lactobacilli from pig feces (2009). Journal of Basic Microbiology, 49 (2), pp. 220-226.

Yurdusev, N. et al., Antagonistic Effect Exerted by Three Strictly Anaerobic Strains Against Various Strains of Clostridium Perfringens in Gnotobiotic Rodent Intestines. Can J Microbiol 33, 226-231 (1987).

Yurdusev, N. et al., InfectInunun 57,724-731 (1989).

Yutin, N. and Galperin, M.Y., A genomic update on clostridial phylogeny:Gram-negative spore formers and other misplaced clostridia. Environmental microbiology. Oct. 2013; 15(10): 2631-2641.

Zhang, B. et al., Oral administration of enterococcus faecalis FK-23 suppresses Th17 cell development and attenuates allergic airway responses in mice. International journal of molecular medicine. 2012; 30:248-254.

Zhang, B. et al., The Prevalence of Th17 Cells in Patients With Gastric Cancer. 2008. Biochem Biophys Res Commun 374 (3), 533-537.

Zhang, et al., The Activation of NF-κB in Infiltrated Mononuclear Cells Negatively Correlates withTreg Cell Frequency in Oral Lichen Planus. Inflammation. Aug. 2015;38(4):1683-9. doi: 10.1007/S10753-015-0145-x.

Zheng, B. et al., Bifidobacteriu breve attenuates murine dextran sodium sulfate-induced colitis and increases regulatory T cell responses. PLOS one. May 2014; 9(5).

Zheng, B., van Bergenhenegouwen, J., Overbeek, S., van de Kant, H.J., Garssen, J., Folkerts, G., et al. (2014). Bifidobacterium breve attenuates murine dextran sodium sulfate-induced colitis and increases regulatory T cell responses. PLoS One 9(5), e95441. doi: 10.1371/journal.pone.0095441.

Zheng, Bin et al., Bifodobacterium breve Attenuates Murine Dexran Doium Sulfate-Induced Colitis and Increases Regulatory T Cell Responses, PLOS ONE, vol. 9, Isue 5, e95441, May 2014.

Zhongyuan, T. et al., The inflammation regulation effects of enterococcus faecium HDRsEfl on human enterocyte-like HT-29 cells. Animal cells and systems. Mar. 2016;20(2):70-76.

Zhou et al. Central and peripheral hypersensitivity in the irritable bowel syndrome. 2010. Pain. 148(3): 454-461.

Zhou, Linghong, and Jane A Foster. "Psychobiotics and the gut-brain axis: in the pursuit of happiness." Neuropsychiatric disease and treatment vol. 11 715-23. Mar. 16, 2015, doi:10.2147/NDT. S61997.

Zhu, S. and Qian, Y., IL-17/IL-17 receptor system in autoimmune disease: mechanisms and therapeutic potential. Clinical Science (2012) 122, 487-511.

Zitomersky, N. et al., Characterization of Adherent Bacteroidales from Intestinal Biopsies of Children and Young Adults with Inflammatory Bowel Disease. PLOS one. 2013; 8(6).

Zitvogel, et al., Type I interferons in anticancer immunity. Nature Reviews. Jul. 2015:405-414.

Advances In The Diagnosis And Treatment Of Type 1 Diabetes, All About Fats—Development And Homeostasis, ADA-Funded Research, 2014, pp. A47-A48.

Ashish K. Marwaha et al.,"TH17 cells in autoimmunity and immunodeficiency: protective or pathogenic?", Frontiers in Immunology, Jun. 2012, vol. 3, Article 129, pp. 1-8, Published online Jun. 4, 2012. Prepublished online Apr. 21, 2012.

Belkaid, Yasmine, and Timothy W Hand. "Role of the microbiota in immunity and inflammation." Cell vol. 157,1 (2014): 121-41. doi:10.1016/J.cell.2014.03.011,Mar. 27, 2014.

Chang H. Kim et al., "Gut Microbiota-Derived Short-Chain Fatty Acids, T Cells, and Inflammation", Immune Network vol. 14, No. 6: 277-288, Dec. 2014, . Epub Dec. 22, 2014.

Chika Kasai et al., "Comparison of the gut microbiota composition between obese and non-obese individuals in a Japanese population, as analyzed by terminal restriction fragment length polymorphism and next-generation sequencing", BMC Gastroenterology (2015)15:100, pp. 1-10, Aug. 11, 2015.

Communication of a notice of opposition to European Patent EP3240554. May 13, 2020, 50 pages.

Drancourt, Michel et al., "16S Ribosomal DNA Sequence Analysis of a Large Collection of Environmental and Clinical Unidentifiable Bacterial Isolates", Journal of Clinical Microbiology, Oct. 2000, 3623-3630.

Gen Bank Accession No. AB196512.1, Ruminococcus productus gene for 16S rRNA, accessed Apr. 16, 2020.

Helena S. Domingues et al.," Functional and Pathogenic Differences of Th1 and Th17 Cells in Experimental Autoimmune Encephalomyelitis", PLoS ONE, Nov. 2010, vol. 5, Issue 11, e15531, pp. 1-13, Published online Nov. 29, 2010.

(56) References Cited

OTHER PUBLICATIONS

Hui Yan et al., "Dietary Fat Content and Fiber Type Modulate Hind Gut Microbial Community and Metabolic Markers in the Pig", PLOS ONE, Apr. 2013, vol. 8, Issue 4, e59581, pp. 1-10, Epub Apr. 3, 2013.

Justesen, Ulrik Stenz et al., "16S rRNA Gene Sequencing in Routine Identification of Anaerobic Bacteria Isolated from Blood Cultures", Journal of Clinical Microbiology, vol. 48, No. 3, Mar. 2010, p. 946-948, 0095-1137/10/$12.00 doi:10.1128/JCM.02075-09, Epub Jan. 13, 2010.

Llosa, Nicolas J et al., "Interleukin-17 and type 17 helper T cells in cancer management and research", Immuno Targets and Therapy, 2014:3, 39-54, Published online Mar. 10, 2014.

M. Touyama et al., "Quantification of Blautia wexlerae and Blautia luti in human faeces by realtime PCR using specific primers", Beneficial Microbes: 6 (4)—pp. 583-590, Published Online: Apr. 22, 2015.

Matthias Lochner et al., "The special relationship in the development and function of T helper 17 and regulatory T cells", Prog Mol Biol Transl Sci, 2015, 136:99-129. (33 pages). Epub Aug. 18, 2015.

Combined Search and Examination Report dated Mar. 1, 2018 for Application No. GB1708176.1, (8 pages).

International Search Report and Written Opinion dated Aug. 16, 2018 for International Application Serial No. PCT/GB2018/051389, (17 pages).

Li, Wei et al., "Structural changes of gut microbiota in Parkinson's disease and its correlation with clinical features", Science China Life Sciences, 2017, vol. 60, No. 11:1223-1233.

\* cited by examiner

Forced swim test

Tail suspension test

Recognition Memory

Marble burying test

Stress-induced hyperthermia

Circulating Oxytocin

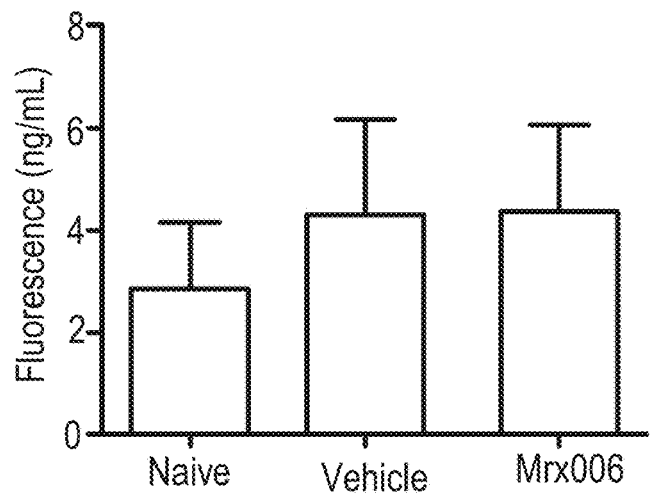
FIG. 11
FIG. 12
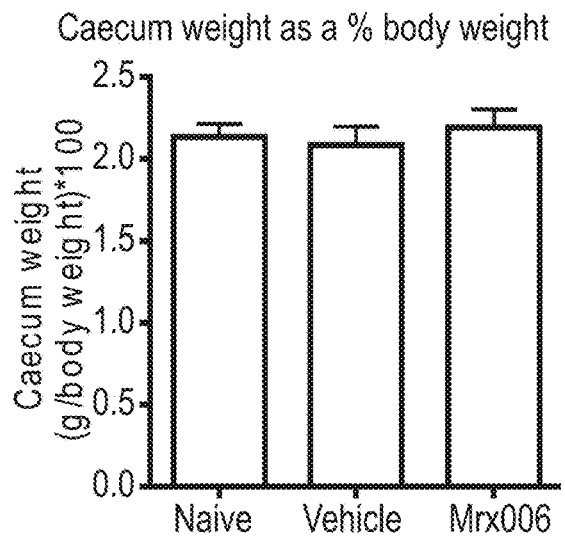
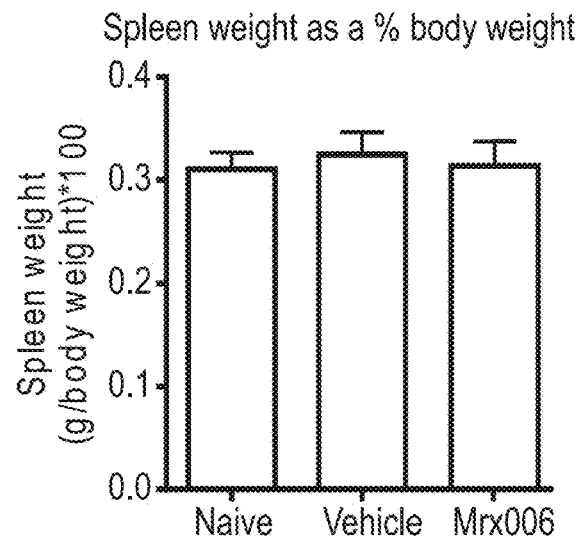
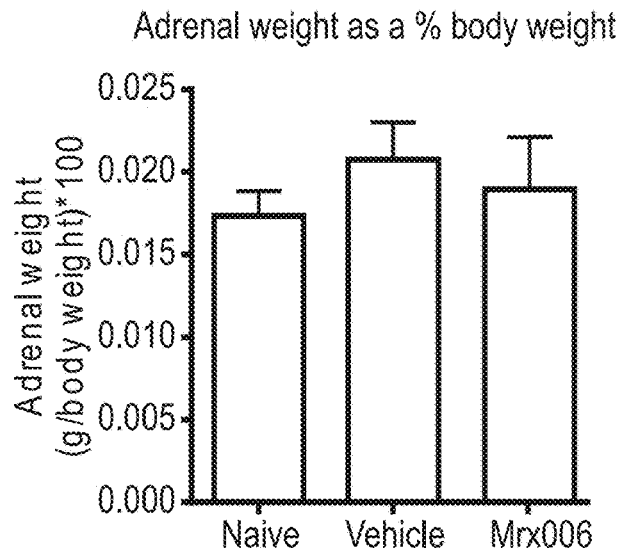
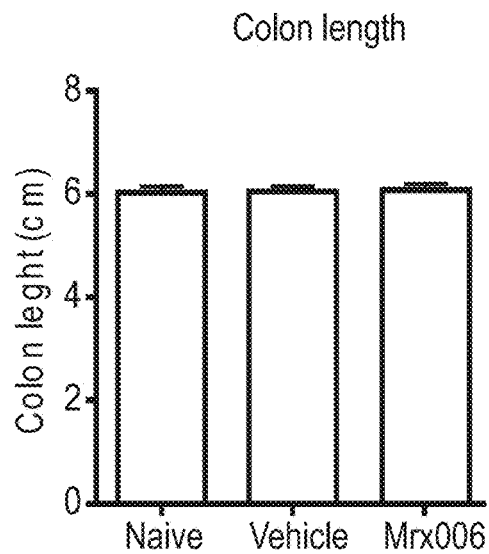

Objective vs conspecific

Familiar vs novel

% Time spent investigating novel conspecific

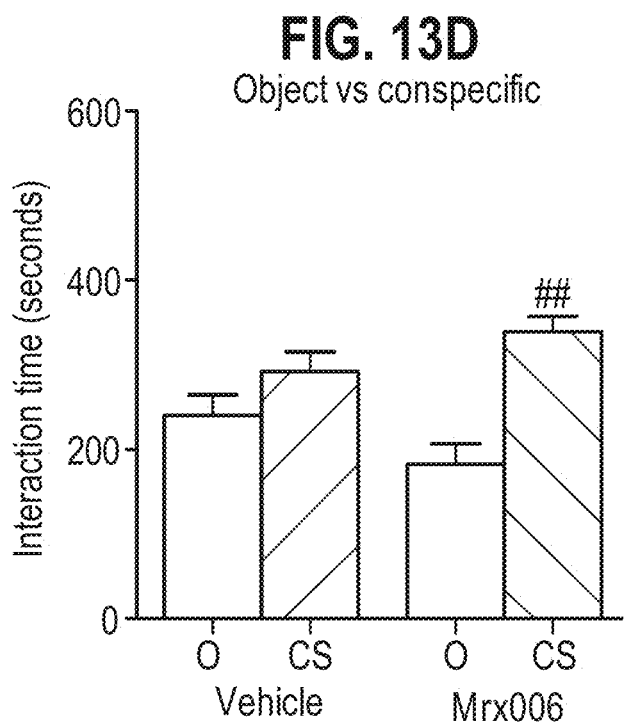
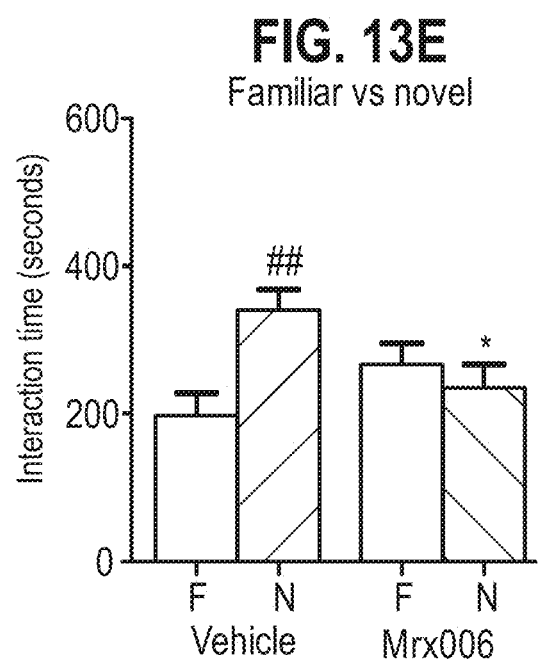
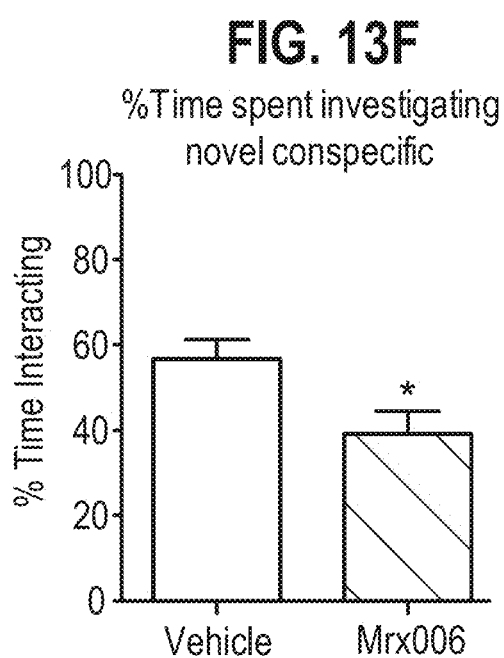

Social interaction

Marble burying test

Grooming

Grooming

% time spent in closed arms

% time spent in open arms

No. entries closed arm

No. entries open arm

Total distance moved

Time spent in outer zone

Time spent in inner zone

Forced swimming test

Female urine sniffing test

Female urine sniffing test

NOR day 1

NOR day 2

NOR discrimination Index in vivo FITC

Carmine red-intestinal motility

Circulating Coritcosterone

Adrenal weight % body weight

Spleen weight % body weight

Caecum weight % body weight

Colon length

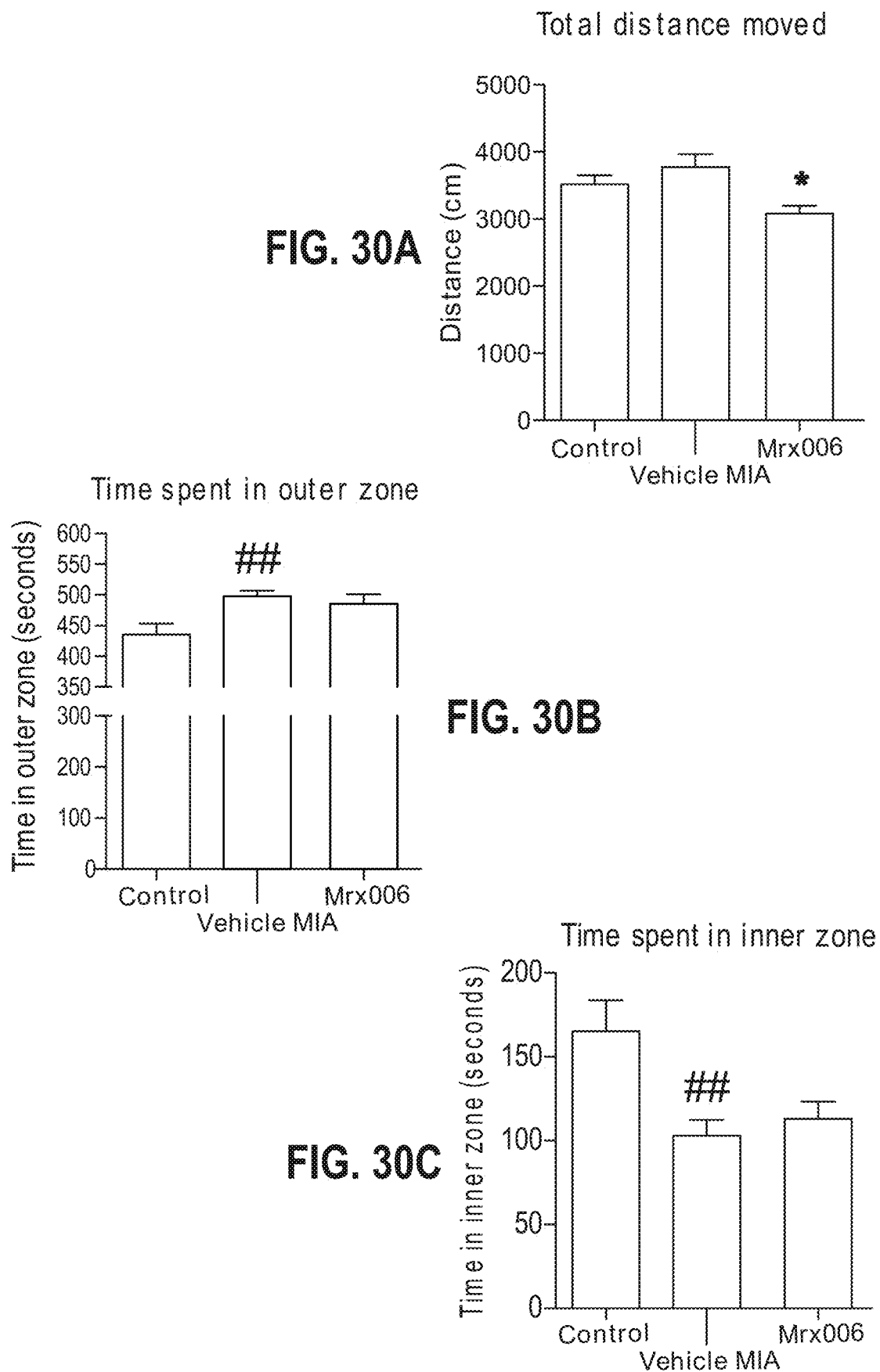

Female urine sniffing test

Intestinal motility

Forced swimming test

In vivo FITC

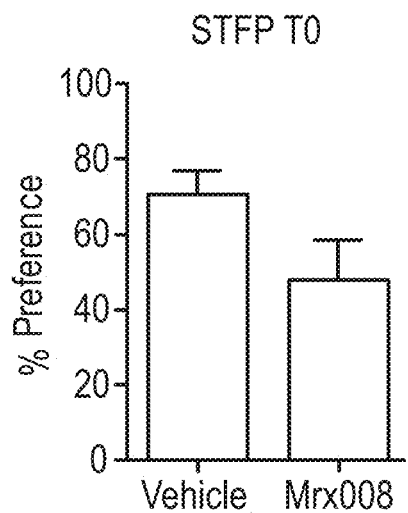
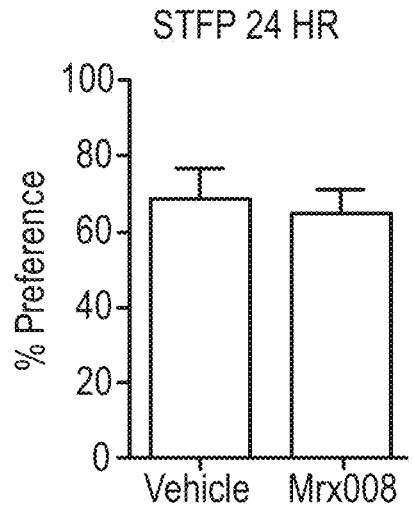
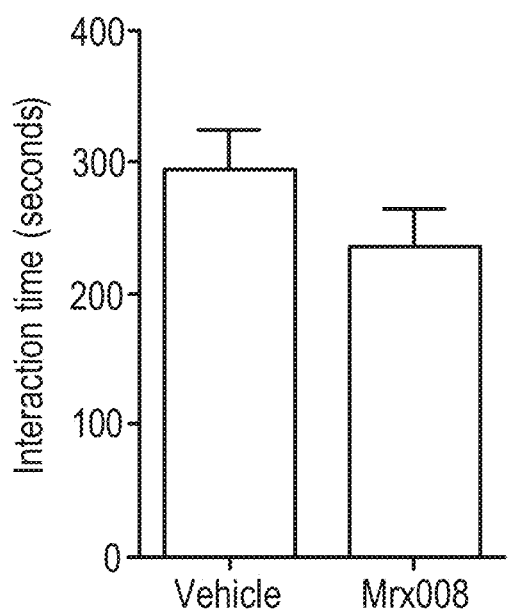
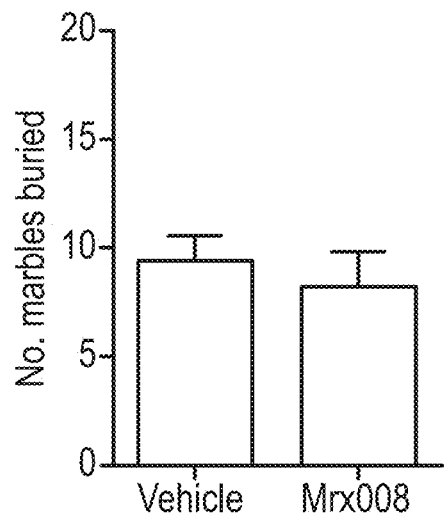

% time spent in closed arms

% time spent in open arms

No. entries closed arms

No. entries open arms

Distance moved

Time spent in outer zone

Time spent inner zone

Forced swimming test

Adrenal weight % body weight

Spleen weight % body weight

Caecum weight % body weight

Colon length

OXTR mRNA

AVPR1b mRNA

OXT mRNA

AV mRNA

OXTR mRNA

AVPR1b mRNA

OXT mRNA

AVP mRNA

Open field data

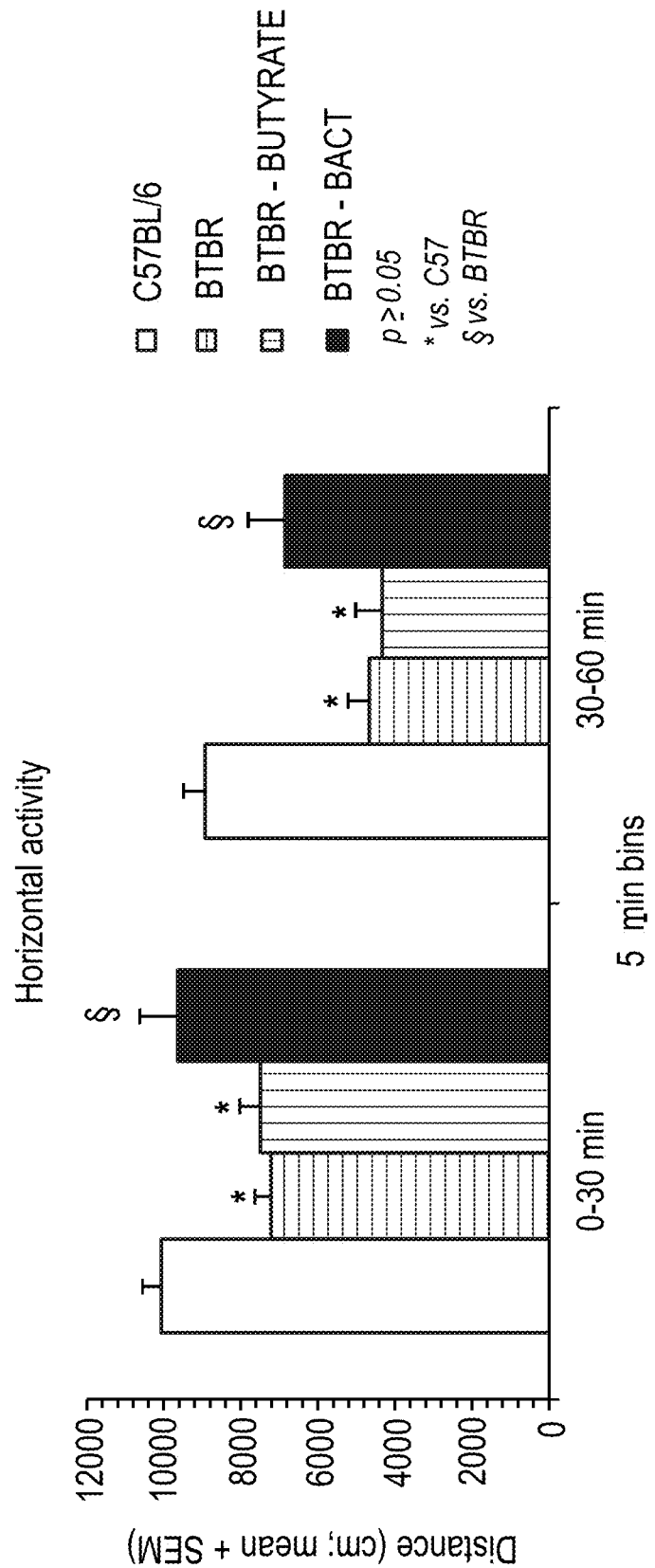

Marbles burying test

Marbles burying test

Digging test

Digging test

Time spent grooming

Time spent grooming

Grooming bouts

Grooming bouts

Grooming time/bouts

Grooming time/bouts

Sociability test

Social novelty test

US 11,376,284 B2

COMPOSITIONS COMPRISING BACTERIAL STRAINS

CROSS-REFERENCE

This application is a continuation of International Application No. PCT/GB2018/051389, filed May 22, 2018, which claims the benefit of Great Britain Application No. 1708176.1, filed May 22, 2017, Great Britain Application No. 1714309.0, filed Sep. 6, 2017, Great Britain Application No. 1714298.5, filed Sep. 6, 2017, Great Britain Application No. 1714305.8, filed Sep. 6, 2017, Great Britain Application No. 1716493.0, filed Oct. 9, 2017, and Great Britain Application No. 1718551.3, filed Nov. 9, 2017, all of which are hereby incorporated by reference in their entirety.

SEQUENCE LISTING

The instant application contains a Sequence Listing which has been submitted electronically in ANSI format and is hereby incorporated by reference in its entirety. Said ANSI copy, created on Nov. 21, 2019, is named 56708_723_301 SL and is 4,325,376 bytes in size.

TECHNICAL FIELD

This invention is in the field of compositions comprising bacterial strains isolated from the mammalian digestive tract and the use of such compositions in the treatment of disease.

BACKGROUND TO THE INVENTION

The human intestine is thought to be sterile in utero, but it is exposed to a large variety of maternal and environmental microbes immediately after birth. Thereafter, a dynamic period of microbial colonization and succession occurs, which is influenced by factors such as delivery mode, environment, diet and host genotype, all of which impact upon the composition of the gut microbiota, particularly during early life. Subsequently, the microbiota stabilizes and becomes adult-like [1]. The human gut microbiota contains more than 500-1000 different phylotypes belonging essentially to two major bacterial divisions, the Bacteroidetes and the Firmicutes [2]. The successful symbiotic relationships arising from bacterial colonization of the human gut have yielded a wide variety of metabolic, structural, protective and other beneficial functions. The enhanced metabolic activities of the colonized gut ensure that otherwise indigestible dietary components are degraded with release of by-products providing an important nutrient source for the host. Similarly, the immunological importance of the gut microbiota is well-recognized and is exemplified in germfree animals which have an impaired immune system that is functionally reconstituted following the introduction of commensal bacteria [3-5].

The discovery of the size and complexity of the human microbiome has resulted in an on-going evaluation of many concepts of health and disease. Certainly, dramatic changes in microbiota composition have been documented in gastrointestinal disorders such as inflammatory bowel disease (IBD)[6-9]. More recently, there is increased interest in the art regarding alternations in the gut microbiome that may play a pathophysiological role in human brain diseases [10]. Preclinical and clinical evidence are strongly suggesting a link between brain development and microbiota [11].

A growing body of preclinical literature has demonstrated bidirectional signalling between the brain and the gut microbiome, involving multiple neurocrine and endocrine signalling systems. Indeed, increased levels of *Clostridium* species in the microbiome have been linked to brain disorders [12], and an imbalance of the Bacteroidetes and Firmicutes phyla has also been implicated in brain development disorders [13]. Suggestions that altered levels of gut commensals, including those of Bifidobacterium, *Lactobacillus*, Sutterella, Prevotella and Ruminococcus genera and of the Alcaligenaceae family are involved in immune-mediated central nervous system (CNS) disorders, are questioned by studies suggesting a lack of alteration in the microbiota between patients and healthy subjects [14]. This indicates that, at present, the practical effect of the link between the microbiome and human brain diseases is poorly characterised. Accordingly, more direct analytical studies are required to identify the therapeutic impact of altering the microbiome on CNS disorders.

In recognition of the potential positive effect that certain bacterial strains may have on the animal gut, various strains have been proposed for use in the treatment of various diseases (see, for example, [14-17]). Also, certain strains, including mostly *Lactobacillus* and *Bifidobacterium* strains, have been proposed for use in treating various inflammatory and autoimmune diseases that are not directly linked to the intestines (see [18] and [19] for reviews). In addition, a range of probiotics have been investigated in animal models to determine a role of the gut microbiome in modulating emotional behaviour, and *Bifidobacterium* and *Lactobacillus* are the main genera showing beneficial effects, reducing anxiety and repetitive behaviours, and increasing social interaction [20-22]. However, the relationship between different diseases and different bacterial strains, and the precise effects of particular bacterial strains on the gut and at a systemic level and on any particular types of diseases, are poorly characterised, particularly for central nervous system diseases.

There is a growing body of evidence to suggest that the microbiota-gut-brain axis is affected in autism spectrum disorders (ASD) and other neurodevelopmental and neuropsychiatric disorders. Animal models have provided considerable insight into how the microbiota may be involved in ASD. Furthermore, preclinical studies have demonstrated that targeting the gut microbiota through administration of beneficial live biotherapeutics display efficacy in improving autistic-related behaviour in animal models, including the maternal immune activation (MIA) mouse model and the black and tan, brachyuric (BTBR) mouse. The BTBR mouse is a genetically modified, inbred mouse strain that displays a number of behaviours associated with ASD such as impaired sociability, repetitive behaviour and increased anxiety. Moreover, these mice also exhibit gastrointestinal dysfunctions along with alterations to the composition of the gut microbiota. Consequently, it represents an appropriate animal model for investigating the role of the microbiota-gut-brain axis in ASD.

Accordingly, there is a requirement in the art for new methods of treating central nervous system disorders. There is also a requirement for the potential effects of gut bacteria to be characterised so that new therapies using gut bacteria can be developed.

SUMMARY OF THE INVENTION

The inventors have developed new therapies for treating and preventing central nervous system disorders. In particular, the inventors have developed new therapies for treating and preventing central nervous system disorders and conditions mediated by the microbiota-gut-brain axis. In particular, the inventors have identified that bacterial strains of the genus *Blautia* can be effective for treating and preventing diseases and conditions mediated by the microbiota-gut-brain axis. As described in the examples, oral administration of compositions comprising a *Blautia* strain may reduce symptoms associated with dysfunction of the microbiota-gut-brain axis in a mouse model of autism spectrum disorders. In addition, as described in the examples, oral administration of compositions comprising a *Blautia* strain may modulate the levels of signalling molecules associated with the function of the microbiota-gut-brain axis, and neurodevelopmental and neuropsychiatric disorders.

Therefore, in a first embodiment, the invention provides a composition comprising a bacterial strain of the genus *Blautia*, for use in a method of treating or preventing a central nervous system disorder or condition. In preferred embodiments, the invention provides a composition comprising a bacterial strain of the species *Blautia stercoris* for use in a method of treating or preventing a central nervous system disorder or condition. Compositions using *Blautia stercoris* may be particularly effective for treating a central nervous system disorder or condition. In certain embodiments, the invention provides a composition comprising a bacterial strain of the species *Blautia wexlerae* for use in a method of treating or preventing a central nervous system disorder or condition. In particular embodiments, the central nervous system disorder or condition is mediated by the microbiota-gut-brain axis. In further embodiments, the invention provides a composition comprising a bacterial strain of the genus *Blautia*, for use in a method of treating or preventing a neurodevelopmental disorder or a neuropsychiatric condition. In preferred embodiments, the invention provides a composition comprising a bacterial strain of the species *Blautia stercoris* for use in a method of treating or preventing a neurodevelopmental disorder or neuropsychiatric condition. Compositions using *Blautia stercoris* may be particularly effective for treating a neurodevelopmental disorder or neuropsychiatric condition. In certain embodiments, the invention provides a composition comprising a bacterial strain of the species *Blautia wexlerae* for use in a method of treating or preventing a neurodevelopmental disorder or neuropsychiatric condition. The inventors have identified that treatment with bacterial strains from this genus can provide clinical benefits in mouse models of central nervous system disorders, in particular those mediated by the microbiota-gut-brain axis. The inventors have identified that treatment with bacterial strains from this genus may modulate signalling in the central, autonomic and enteric nervous systems; may modulate the activity of the hypothalamus-pituitary-adrenal (HPA) axis pathway; may modulate neuroendocrine and/or neuroimmune pathways; and/or may modulate the levels of commensal metabolites, inflammatory markers and/or gastrointestinal permeability of a subject. Compositions using *Blautia stercoris* may be particularly effective at modulating signalling in the central, autonomic and enteric nervous systems; modulating the activity of the hypothalamus-pituitary-adrenal (HPA) axis pathway; modulating neuroendocrine and/or neuroimmune pathways; and/or modulating the levels of commensal metabolites, inflammatory markers and/or gastrointestinal permeability of a subject. In certain embodiments compositions using *Blautia wexlerae* may also be effective.

In particular embodiments, the invention provides a composition comprising a bacterial strain of the genus *Blautia*, for use in a method of treating or preventing a disease or condition selected from the group consisting of: autism spectrum disorders (ASDs); child developmental disorder; obsessive compulsive disorder (OCD); major depressive disorder; depression; seasonal affective disorder; anxiety disorders; chronic fatigue syndrome (myalgic encephalomyelitis); stress disorder; post-traumatic stress disorder; schizophrenia spectrum disorders; schizophrenia; bipolar disorder; psychosis; mood disorder; dementia; Alzheimer's; Parkinson's disease; and/or chronic pain. In further embodiments, the compositions of the invention may be useful for treating or preventing multiple sclerosis; motor neuron disease; Huntington's disease; Guillain-Barre syndrome and/or meningitis. The effect shown for the bacterial strains from the genus *Blautia* on the microbiota-gut-brain axis and on diseases mediated by the microbiota-gut-brain axis may provide therapeutic benefits for other diseases and conditions mediated by the microbiota-gut-brain axis, such as those listed above. In other embodiments, the invention provides a composition comprising a bacterial strain of the genus *Blautia*, for use in a method of treating comorbidities associated with diseases and conditions mediated by the microbiota-gut-brain axis, such as those listed above. In particularly preferred embodiments, the invention provides a composition comprising a bacterial strain of the genus *Blautia*, for use in a method of treating gastrointestinal comorbidities associated with diseases and conditions mediated by the microbiota-gut-brain axis, such as those listed above. The mouse model experiments used in this application for the assessment of the symptoms of autism spectrum disorders are known in the art to be applicable for the assessment of the symptoms other central nervous system disorders including those listed above [23-25].

In particularly preferred embodiments, the invention provides a composition comprising a bacterial strain of the genus *Blautia*, for use in a method of treating or preventing autism spectrum disorders, such as autism. The inventors have identified that treatment with *Blautia* strains can reduce symptom severity in a mouse model of autism spectrum disorders and can prevent or reduce stereotyped, repetitive, compulsive and anxious behaviour. In preferred embodiments, the invention provides a composition comprising a bacterial strain of the genus *Blautia*, for use in the treatment of autism spectrum disorders. Compositions using *Blautia* may be particularly effective for treating autism spectrum disorders. In preferred embodiments, the invention provides a composition for use in reducing stereotyped, repetitive, compulsive or anxious behaviour, in particular in the treatment of autism spectrum disorders. In preferred embodiments, the invention provides a composition comprising a bacterial strain of the genus *Blautia*, for use in the treatment of the behavioural symptoms of autism spectrum disorders. In preferred embodiments, the invention provides a composition comprising a bacterial strain of the genus *Blautia* for use in the treatment of the gastrointestinal symptoms of autism spectrum disorders. In preferred embodiments, the invention provides a composition comprising a bacterial strain of the genus *Blautia*, for use in the treatment of the behavioural and gastrointestinal symptoms of autism spectrum disorders. Treatment with *Blautia* strains may modulate signalling in the central, autonomic and enteric nervous systems; may modulate the activity of the HPA axis pathway; may modulate neuroendocrine and/or neuroimmune pathways; and/or may modulate the levels of commensal metabolites, inflammatory markers and/or gastrointestinal permeability of a subject, all of which are implicated in the neuropathology of autism spectrum disorders. In certain embodiments, treatment with *Blautia* strains may modulate the levels of oxytocin and/or vasopressin hormones. In preferred embodiments, the invention provides a composition comprising a bacterial strain of the species *Blautia stercoris* for use in a method of treating or preventing autism spectrum disorders. Compositions using *Blautia stercoris* may be particularly effective for treating autism spectrum disorders. In certain embodiments, the invention provides a composition comprising a bacterial strain of the species *Blautia wexlerae* for use in a method of treating or preventing autism spectrum disorders.

In further preferred embodiments, the invention provides a composition comprising a bacterial strain of the genus *Blautia*, for use in a method of treating or preventing obsessive compulsive disorder (OCD). In preferred embodiments, the invention provides a composition for use in reducing stereotyped, repetitive, compulsive or anxious behaviour in the treatment of OCD. Treatment with *Blautia* strains may modulate signalling in the central, autonomic and enteric nervous systems; may modulate the activity of the HPA axis pathway; may modulate neuroendocrine and/or neuroimmune pathways; and/or may modulate the levels of commensal metabolites and/or gastrointestinal permeability of a subject, all of which are implicated in the neuropathology of OCD. In preferred embodiments, the invention provides a composition comprising a bacterial strain of the species *Blautia stercoris* for use in a method of treating or preventing OCD. Compositions using *Blautia stercoris* may be particularly effective for treating OCD. In certain embodiments, the invention provides a composition comprising a bacterial strain of the species *Blautia wexlerae* for use in a method of treating or preventing OCD.

In further preferred embodiments, the invention provides a composition comprising a bacterial strain of the genus *Blautia*, for use in a method of treating or preventing major depressive disorder (MDD). Treatment with *Blautia* strains may provide clinical benefits in a mouse model of depression. In preferred embodiments, the invention provides a composition comprising a bacterial strain of the genus *Blautia*, for use in the treatment of depression. Compositions using *Blautia* strains may be particularly effective for treating depression. In preferred embodiments, the invention provides a composition for use in reducing stereotyped, repetitive, compulsive or anxious behaviour in the treatment of depression. Treatment with *Blautia* strains may modulate signalling in the central, autonomic and enteric nervous systems; may modulate the activity of the HPA axis pathway; may modulate neuroendocrine and/or neuroimmune pathways; and may modulate the levels of commensal metabolites, inflammatory markers and/or gastrointestinal permeability of a subject, all of which are implicated in the neuropathology of MDD. In certain embodiments, treatment with *Blautia* strains may modulate the levels of oxytocin and/or vasopressin hormones. In preferred embodiments, the invention provides a composition comprising a bacterial strain of the species *Blautia stercoris* for use in a method of treating or preventing MDD. Compositions using *Blautia stercoris* may be particularly effective for treating MDD. In certain embodiments, the invention provides a composition comprising a bacterial strain of the species *Blautia wexlerae* for use in a method of treating or preventing MDD.

In further preferred embodiments, the invention provides a composition comprising a bacterial strain of the genus *Blautia*, for use in a method of treating or preventing anxiety disorders. Treatment with *Blautia* strains reduces disease incidence and disease severity in a mouse model of anxiety in the examples of this application. In preferred embodiments, the invention provides a composition comprising a bacterial strain of the genus *Blautia*, for use in the treatment of anxiety disorder. Compositions using *Blautia* strains may be particularly effective for treating anxiety disorder. In preferred embodiments, the invention provides a composition for use in reducing stereotyped, repetitive, compulsive or anxious behaviour in the treatment of anxiety. In preferred embodiments, the invention provides a composition comprising a bacterial strain of the species *Blautia stercoris* for use in a method of treating or preventing anxiety disorders. Compositions using *Blautia stercoris* may be particularly effective for treating anxiety disorders. In certain embodiments, the invention provides a composition comprising a bacterial strain of the species *Blautia wexlerae* for use in a method of treating or preventing anxiety disorders.

In further preferred embodiments, the invention provides a composition comprising a bacterial strain of the genus *Blautia*, for use in a method of treating or preventing stress disorders, such as post-traumatic stress disorder. Compositions comprising a bacterial strain of the genus *Blautia* may reduce stress in mouse models of stress disorders. Treatment with *Blautia* strains may modulate signalling in the central, autonomic and enteric nervous systems; may modulate the activity of the HPA axis pathway; may modulate neuroendocrine and/or neuroimmune pathways; and may modulate the levels of commensal metabolites, inflammatory markers and/or gastrointestinal permeability of a subject, all of which are implicated in the neuropathology of stress disorder. In certain embodiments, treatment with *Blautia* strains may modulate the levels of oxytocin and/or vasopressin hormones. In preferred embodiments, the invention provides a composition comprising a bacterial strain of the species Blautia stercoris for use in a method of treating or preventing stress disorders. Compositions using Blautia stercoris may be particularly effective for treating stress disorders. In certain embodiments, the invention provides a composition comprising a bacterial strain of the species *Blautia wexlerae* for use in a method of treating or preventing stress disorders.

In further preferred embodiments, the invention provides a composition comprising a bacterial strain of the genus *Blautia*, for use in a method of treating or preventing schizophrenia spectrum and psychotic disorders, such as schizophrenia. Compositions comprising a bacterial strain of the genus *Blautia* may improve positive and negative symptoms in mouse models of schizophrenia spectrum and psychotic disorders. Treatment with *Blautia* strains may modulate signalling in the central, autonomic and enteric nervous systems; may modulate the activity of the HPA axis pathway; may modulate neuroendocrine and/or neuroimmune pathways; and may modulate the levels of commensal metabolites and/or gastrointestinal permeability of a subject, all of which are implicated in the neuropathology of schizophrenia spectrum and psychotic disorders. In preferred embodiments, the invention provides a composition comprising a bacterial strain of the species *Blautia stercoris* for use in a method of treating or preventing schizophrenia spectrum and psychotic disorders. Compositions using *Blautia stercoris* may be particularly effective for treating schizophrenia spectrum and psychotic disorders. In certain embodiments, the invention provides a composition comprising a bacterial strain of the species *Blautia wexlerae* for use in a method of treating or preventing schizophrenia spectrum and psychotic disorders.

In further preferred embodiments, the invention provides a composition comprising a bacterial strain of the genus *Blautia*, for use in a method of treating or preventing bipolar disorder. Compositions comprising a bacterial strain of the genus *Blautia* may reduce occasions of mania and/or depression in mouse models of bipolar disorder. Treatment with

*Blautia* strains may modulate signalling in the central, autonomic and enteric nervous systems; may modulate the activity of the HPA axis pathway; may modulate neuroendocrine and/or neuroimmune pathways; and may modulate the levels of commensal metabolites, inflammatory markers and/or gastrointestinal permeability of a subject, all of which are implicated in the neuropathology of bipolar disorder. In certain embodiments, treatment with *Blautia* strains may modulate the levels of oxytocin and/or vasopressin hormones. In preferred embodiments, the invention provides a composition comprising a bacterial strain of the species *Blautia stercoris* for use in a method of treating or preventing bipolar disorder. Compositions using *Blautia stercoris* may be particularly effective for treating bipolar disorder. In certain embodiments, the invention provides a composition comprising a bacterial strain of the species *Blautia wexlerae* for use in a method of treating or preventing bipolar disorder.

In further preferred embodiments, the invention provides a composition comprising a bacterial strain of the genus *Blautia*, for use in a method of treating or preventing neurocognitive disorders, such as Alzheimer's disease. Compositions comprising a bacterial strain of the species genus *Blautia* may improve cognitive and behavioural functioning in mouse models of neurocognitive disorders. Treatment with *Blautia* strains may modulate signalling in the central, autonomic and enteric nervous systems; may modulate the activity of the HPA axis pathway; may modulate neuroendocrine and/or neuroimmune pathways; and may modulate the levels of commensal metabolites and/or gastrointestinal permeability of a subject, all of which are implicated in the neuropathology of neurocognitive disorders. In preferred embodiments, the invention provides a composition comprising a bacterial strain of the species *Blautia stercoris* for use in a method of treating or preventing neurocognitive disorders. Compositions using *Blautia stercoris* may be particularly effective for treating neurocognitive disorders. In certain embodiments, the invention provides a composition comprising a bacterial strain of the species *Blautia wexlerae* for use in a method of treating or preventing neurocognitive disorders.

In further preferred embodiments, the invention provides a composition comprising a bacterial strain of the genus *Blautia*, for use in a method of treating or preventing Parkinson's disease. Compositions comprising a bacterial strain of the genus *Blautia* may improve motor and cognitive functions in mouse models of Parkinson's disease. Treatment with *Blautia* strains may modulate signalling in the central, autonomic and enteric nervous systems; may modulate the activity of the HPA axis pathway; may modulate neuroendocrine and/or neuroimmune pathways; and may modulate the levels of commensal metabolites, inflammatory markers and/or gastrointestinal permeability of a subject, all of which are implicated in the neuropathology of Parkinson's disease. In certain embodiments, treatment with *Blautia* strains may modulate the levels of oxytocin and/or vasopressin hormones. In preferred embodiments, the invention provides a composition comprising a bacterial strain of the species *Blautia stercoris* for use in a method of treating or preventing Parkinson's disease. Compositions using *Blautia stercoris* may be particularly effective for treating Parkinson's disease. In certain embodiments, the invention provides a composition comprising a bacterial strain of the species *Blautia wexlerae* for use in a method of treating or preventing Parkinson's disease.

In certain embodiments, the invention provides a composition comprising a bacterial strain of the species *Blautia hydrogenotrophica* for use in a method of treating or preventing a central nervous system disorder or condition. Compositions using *Blautia hydrogenotrophica* may be particularly effective for treating a central nervous system disorder or condition.

In certain embodiments, the invention provides a composition comprising a bacterial strain of the species *Blautia hydrogenotrophica* for use in a method of treating or preventing a neurodevelopmental disorder or neuropsychiatric condition. Compositions using *Blautia hydrogenotrophica* may be particularly effective for treating a neurodevelopmental disorder or neuropsychiatric condition.

Compositions using *Blautia hydrogenotrophica* may be particularly effective at modulating signalling in the central, autonomic and enteric nervous systems; modulating the activity of the hypothalamus-pituitary-adrenal (HPA) axis pathway; modulating neuroendocrine and/or neuroimmune pathways; and/or modulating the levels of commensal metabolites, inflammatory markers and/or gastrointestinal permeability of a subject. In a particularly preferred embodiment, *Blautia hydrogenotrophica* modulates the levels of butyrate. In certain embodiments, the modulation of the levels of butyrate treats or prevents a central nervous system disorder or condition.

In certain embodiments, the invention provides a composition comprising a bacterial strain of the species *Blautia hydrogenotrophica* for use in a method of treating or preventing autism spectrum disorders. Compositions using *Blautia hydrogenotrophica* may be particularly effective for treating autism spectrum disorders.

In certain embodiments, the invention provides a composition comprising a bacterial strain of the species *Blautia hydrogenotrophica* for use in a method of treating or preventing OCD. Compositions using *Blautia hydrogenotrophica* may be particularly effective for treating OCD.

In certain embodiments, the invention provides a composition comprising a bacterial strain of the species *Blautia hydrogenotrophica* for use in a method of treating or preventing MDD. Compositions using *Blautia hydrogenotrophica* may be particularly effective for treating MDD.

In certain embodiments, the invention provides a composition comprising a bacterial strain of the species *Blautia hydrogenotrophica* for use in a method of treating or preventing anxiety disorders. Compositions using *Blautia hydrogenotrophica* may be particularly effective for treating anxiety disorders.

In certain embodiments, the invention provides a composition comprising a bacterial strain of the species *Blautia hydrogenotrophica* for use in a method of treating or preventing stress disorders. Compositions using *Blautia hydrogenotrophica* may be particularly effective for treating stress disorders.

In certain embodiments, the invention provides a composition comprising a bacterial strain of the species *Blautia hydrogenotrophica* for use in a method of treating or preventing schizophrenia spectrum and psychotic disorders. Compositions using *Blautia hydrogenotrophica* may be particularly effective for treating schizophrenia spectrum and psychotic disorders.

In certain embodiments, the invention provides a composition comprising a bacterial strain of the species *Blautia hydrogenotrophica* for use in a method of treating or preventing bipolar disorder. Compositions using *Blautia hydrogenotrophica* may be particularly effective for treating bipolar disorder.

In certain embodiments, the invention provides a composition comprising a bacterial strain of the species *Blautia*

*hydrogenotrophica* for use in a method of treating or preventing neurocognitive disorders. Compositions using *Blautia hydrogenotrophica* may be particularly effective for treating neurocognitive disorders.

In certain embodiments, the invention provides a composition comprising a bacterial strain of the species *Blautia hydrogenotrophica* for use in a method of treating or preventing Parkinson's disease. Compositions using *Blautia hydrogenotrophica* may be particularly effective for treating Parkinson's disease.

In certain embodiments, the compositions of the invention are for use in a method of modulating the microbiota-gut-brain axis in the treatment or prevention of a disease or condition mediated by the microbiota-gut-brain axis. In particular, the compositions of the invention may be used in modulating the microbiota-gut-brain axis in the treatment or prevention of autism spectrum disorders; obsessive compulsive disorder; major depressive disorder; anxiety disorders; stress disorders; schizophrenia spectrum disorders; bipolar disorders; neurocognitive disorders and Parkinson's disease.

In preferred embodiments of the invention, the bacterial strain in the composition is of *Blautia stercoris*. Closely related strains may also be used, such as bacterial strains that have a 16s rRNA sequence that is at least 95%, 96%, 97%, 98%, 99%, 99.5% or 99.9% identical to the 16s rRNA sequence of a bacterial strain of *Blautia stercoris*. Preferably, the bacterial strain has a 16s rRNA sequence that is at least 95%, 96%, 97%, 98%, 99%, 99.5% or 99.9% identical to SEQ ID NO: 1 or 2. Preferably, the sequence identity is to SEQ ID NO: 2. Preferably, the bacterial strain for use in the invention has the 16s rRNA sequence represented by SEQ ID NO: 2.

In preferred embodiments of the invention, the bacterial strain in the composition is of *Blautia wexlerae*. Closely related strains may also be used, such as bacterial strains that have a 16s rRNA sequence that is at least 95%, 96%, 97%, 98%, 99%, 99.5% or 99.9% identical to the 16s rRNA sequence of a bacterial strain of *Blautia wexlerae*. Preferably, the bacterial strain has a 16s rRNA sequence that is at least 95%, 96%, 97%, 98%, 99%, 99.5% or 99.9% identical to SEQ ID NO: 3 or 4. Preferably, the sequence identity is to SEQ ID NO: 4. Preferably, the bacterial strain for use in the invention has the 16s rRNA sequence represented by SEQ ID NO: 4.

In preferred embodiments of the invention, the bacterial strain in the composition is of *Blautia hydrogenotrophica*. Closely related strains may also be used, such as bacterial strains that have a 16s rRNA sequence that is at least 95%, 96%, 97%, 98%, 99%, 99.5% or 99.9% identical to the 16s rRNA sequence of a bacterial strain of *Blautia hydrogenotrophica*. Preferably, the bacterial strain has a 16s rRNA sequence that is at least 95%, 96%, 97%, 98%, 99%, 99.5% or 99.9% identical to SEQ ID NO: 7. Most preferably, the bacterial strain in the composition is the *Blautia hydrogenotrophica* strain deposited under accession number DSM 14294.

In certain embodiments, the composition of the invention is for oral administration. Oral administration of the strains of the invention can be effective for treating central nervous system disorders and conditions, in particular those mediated by the microbiota-gut-brain axis. Also, oral administration is convenient for patients and practitioners and allows delivery to and/or partial or total colonisation of the intestine.

In certain embodiments, the composition of the invention comprises one or more pharmaceutically acceptable excipients or carriers.

In certain embodiments, the composition of the invention comprises a bacterial strain that has been lyophilised. Lyophilisation is an effective and convenient technique for preparing stable compositions that allow delivery of bacteria.

In certain embodiments, the invention provides a food product comprising the composition as described above.

In certain embodiments, the invention provides a vaccine composition comprising the composition as described above.

Additionally, the invention provides a method of treating or preventing a disease or condition mediated by dysfunction of the microbiota-gut-brain axis, comprising administering a composition comprising a bacterial strain of the genus *Blautia*.

In developing the above invention, the inventors have identified and characterised a bacterial strain that is particularly useful for therapy. The *Blautia stercoris* strain of the invention is shown to be effective for treating the diseases described herein, such as autism spectrum disorder. Therefore, in another aspect, the invention provides a cell of the *Blautia stercoris* strain deposited under accession number NCIMB 42381, or a derivative thereof. The invention also provides compositions comprising such cells, or biologically pure cultures of such cells. The invention also provides a cell of the *Blautia stercoris* strain deposited under accession number NCIMB 42381, or a derivative thereof, for use in therapy, in particular for the diseases described herein.

In especially preferred embodiments, the invention provides a composition comprising the strain deposited under accession number NCIMB 42381, for use in a method of treating or preventing a central nervous system disorder or condition. In especially preferred embodiments, the invention provides a composition comprising the strain deposited under accession number NCIMB 42381, for use in a method of treating or preventing a neurodevelopmental disorder or a neuropsychiatric condition. In especially preferred embodiments, the invention provides a composition comprising the strain deposited under accession number NCIMB 42381, for use in a method of treating or preventing autism spectrum disorder, or preferably autism. In especially preferred embodiments, the invention provides a composition comprising the strain deposited under accession number NCIMB 42381, for use in a method of reducing stereotyped, repetitive, compulsive or anxious behaviour, especially in the treatment of autism.

In developing the above invention, the inventors have identified and characterised a further bacterial strain that is particularly useful for therapy. The *Blautia wexlerae* strain of the invention is shown to be effective for treating the diseases described herein, such as autism spectrum disorder. Therefore, in another aspect, the invention provides a cell of the *Blautia wexlerae* strain deposited under accession number NCIMB 42486, or a derivative thereof. The invention also provides compositions comprising such cells, or biologically pure cultures of such cells. The invention also provides a cell of the Blautia wexlerae strain deposited under accession number NCIMB 42486, or a derivative thereof, for use in therapy, in particular for the diseases described herein.

In especially preferred embodiments, the invention provides a composition comprising the strain deposited under accession number NCIMB 42486, for use in a method of treating or preventing a central nervous system disorder or condition. In especially preferred embodiments, the invention provides a composition comprising the strain deposited under accession number NCIMB 42486, for use in a method of treating or preventing a neurodevelopmental disorder or a neuropsychiatric condition. In especially preferred embodiments, the invention provides a composition comprising the strain deposited under accession number NCIMB 42486, for use in a method of treating or preventing autism spectrum disorder, or preferably autism. In especially preferred embodiments, the invention provides a composition comprising the strain deposited under accession number NCIMB 42486, for use in a method of reducing stereotyped, repetitive, compulsive or anxious behaviour, especially in the treatment of autism.

In developing the above invention, the inventors have identified and characterised a bacterial strain that is particularly useful for therapy. The *Blautia hydrogenotrophica* strain of the invention is shown to be effective for treating the diseases described herein, such as autism spectrum disorder. Therefore, in another aspect, the invention provides a cell of the *Blautia hydrogenotrophica* strain deposited under accession number DSM 14294, or a derivative thereof. The invention also provides compositions comprising such cells, or biologically pure cultures of such cells. The invention also provides a cell of the *Blautia hydrogenotrophica* strain deposited under accession number DSM 14294, or a derivative thereof, for use in therapy, in particular for the diseases described herein.

In especially preferred embodiments, the invention provides a composition comprising the strain deposited under accession number DSM 14294, for use in a method of treating or preventing a central nervous system disorder or condition. In especially preferred embodiments, the invention provides a composition comprising the strain deposited under accession number DSM 14294 for use in a method of treating or preventing a neurodevelopmental disorder or a neuropsychiatric condition. In especially preferred embodiments, the invention provides a composition comprising the strain deposited under accession number DSM 14294, for use in a method of treating or preventing autism spectrum disorder, or preferably autism. In especially preferred embodiments, the invention provides a composition comprising the strain deposited under accession number DSM 14294, for use in a method of reducing stereotyped, repetitive, compulsive or anxious behaviour, especially in the treatment of autism.

BRIEF DESCRIPTION OF DRAWINGS

FIG. 4A, Acquisition; FIG. 4B, Retrieval; FIG. 4C, Extinction.

FIG. 7A, Time spent in closed arms; FIG. 7B, % Time in closed arms; FIG. 7C, Time spent in open arms; FIG. 7D, % Time in open arms.

FIG. 11: Effect of treatment with MRX006 on gut permeability in C57Bl/6 mice.

FIG. 12: Effect of treatment with MRX006 on organ weight and colon length in C57Bl/6 mice.

FIGS. 13A-13F: Effect of treatment with MRX006 on BTBR mice in the three chamber social interaction test. $\#\#p<0.01$ relative to respective within group. $\#\#\#p<0.001$ relative to respective within group. $*p<0.05$ relative to vehicle group. FIG. 13A, Time in chamber, objective vs conspecific; FIG. 13B, Time in chamber, familiar vs novel; FIG. 13C, % Time, % Time spent investigating novel conspecific; FIG. 13D, Interaction time, objective vs conspecific; FIG. 13E, Interaction time, familiar vs novel; FIG. 13F, % Time interacting, % Time spent investigating novel conspecific.

FIG. 16A, Grooming time, vehicle vs Mrx006; FIG. 16B Grooming time, grooming.

FIG. 17A, % time spent in closed arms; FIG. 17B, % time spent in open arms; FIG. 17C, No. entries to closed arm; FIG. 17D, No. entries to open arm.

FIG. 18A, Total distance moved; FIG. 18B, Time spent in outer zone;

FIG. 18C, Time spent in inner zone; FIG. 18D, Total distance moved; FIG. 18E, Time spent in outer zone; FIG. 18F, Time spent in inner zone.

FIG. 20A, Time spent sniffing, Female urine sniffing test; FIG. 20B, Female urine sniffing test, vehicle vs Mrx006, water vs urine.

FIG. 21A, NOR day 1; FIG. 21B, NOR day 2; FIG. 21C, NOR discrimination Index.

FIG. 22A, Ex vivo colon; FIG. 22B, Ex vivo ileum.

FIG. 26A, Adrenal weight % body weight; FIG. 26B, Spleen weight % body weight; FIG. 26C, Caecum weight % body weight; FIG. 26D, Colon length.

FIG. 29A, 0 Hour; FIG. 29B, 24 Hour.

FIGS. 30A-30C: Chronic treatment with MRX006 attenuates stress-induced locomotor activity caused by exposure to the open field arena in MIA mice. $\#\#p<0.01$ relative to control group, $*p<0.05$ relative to vehicle MIA group. FIG. 30A, Total distance moved; FIG. 30B, Time spent in outer zone; FIG. 30C, Time spent in inner zone.

FIG. 33A, Colon length; FIG. 33B, Caecum weight % body weight; FIG. 33C, Spleen weight % body weight.

FIG. 35A, control vs. vehicle vs. Mrx008; FIG. 35B, control vs. vehicle.

FIG. 36A, T0; FIG. 36B, T24.

FIGS. 40A-40B: Effect of chronic treatment with MRX008 on BTBR mice in the social transmission of food preference test. FIG. 40A, STFP T0; FIG. 40B, STFP 24 HR.

FIG. 41: Effect of chronic treatment with MRX008 on BTBR mice in the forced intruder test.

FIG. 42: Effect of chronic treatment with MRX008 on BTBR mice in the marble burying test.

FIG. 43A, % time spent in closed arms; FIG. 43B, % time spent in open arms; FIG. 43C, No. entries to closed arms; FIG. 43D, No. entries to open arms.

FIG. 44A, Distance moved; FIG. 44B, Time spent in outer zone; FIG. 44C, Time spent inner zone.

FIG. 48A, Adrenal weight % body weight; FIG. 48B, Spleen weight % body weight; FIG. 48C, Caecum weight % body weight; FIG. 48D, Colon length.

FIG. 49A, OXTR mRNA; FIG. 49B, AVPR1b mRNA; FIG. 49C, OXT mRNA; FIG. 49D, AV mRNA.

FIG. 50A, OXTR mRNA; FIG. 50B, AVPR1b mRNA; FIG. 50C, OXT mRNA; FIG. 50D, AVP mRNA.

FIGS. 51A-51H: Effect of chronic treatment with Blautia hydrogenotrophica and butyrate on BTBR mice in the open field arena. The data in FIGS. 51B, 51D, 51F and 51H are identical to that in FIGS. 51A, 51C, 51E and 51G, respectively, except the PBS and LYO control numbers have been pooled. $p<0.05$: * vs. C57BL/6 (same treatment, where applicable); # vs. PBS same genotype; § BTBR: But vs. PBS or Bact vs. Lyo. PBS is the negative control for butyrate administration; LYO is the negative control for bacterial (Blautia hydrogenotrophica) administration; BUT is the experimental administration of butyrate; BACT is the experimental administration of Blautia hydrogenotrophica.

FIG. 53A shows the time spent digging, while FIG. 53B shows the number of digging bouts. $p<0.05$: * vs. C57BL/6 (same treatment, where applicable); # vs. PBS same genotype; § BTBR: But vs. PBS or Bact vs. Lyo. PBS is the negative control for butyrate administration; LYO is the negative control for bacterial (Blautia hydrogenotrophica) administration; BUT is the experimental administration of butyrate; BACT is the experimental administration of Blautia hydrogenotrophica.

FIG. 54A shows the time spent grooming; FIG. 54C shows the number of grooming bouts, and FIG. 54E shows the time spent grooming per bout. The data in FIGS. 54B, 54D and 54F are identical to FIGS. 54A, 54C, and 54E respectively, except the PBS and LYO control numbers have been pooled. P<0.05: * vs. C57BL/6 (same treatment, where applicable); # vs. PBS same genotype; § BTBR: But vs. PBS or Bact vs. Lyo. PBS is the negative control for butyrate administration; LYO is the negative control for bacterial (Blautia hydrogenotrophica) administration; BUT is the experimental administration of butyrate; BACT is the experimental administration of *Blautia hydrogenotrophica*.

FIG. 57A shows concentration of total SCFA. FIG. 57B shows concentration of Acetic acid, Propionic acid and Butyric acid.

FIG. 58A shows the effect of administration on sociability (the preference for sniffing an object or another mouse), while FIG. 58B shows the preference for social novelty (i.e. sniffing a new mouse vs. a familiar mouse). p≤0.05: S vs. 50%; * vs. C57BL/6 (same treatment, where applicable); # vs. PBS same genotype; § BTBR: But vs. PBS or Bact vs. Lyo. PBS is the negative control for butyrate administration; LYO is the negative control for bacterial (*Blautia hydrogenotrophica*) administration; BUT is the experimental administration of butyrate; BACT is the experimental administration of *Blautia hydrogenotrophica*.

DISCLOSURE OF THE INVENTION

Bacterial Strains

Figure 1A:
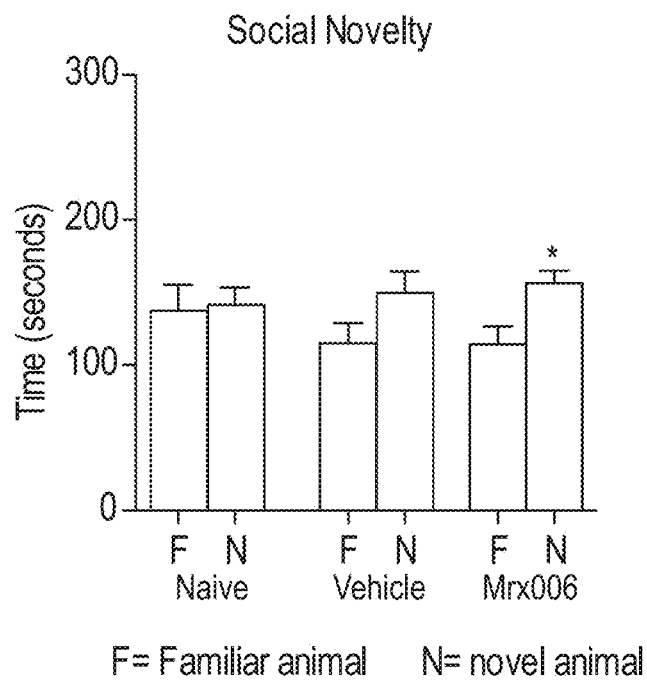
FIGS. 1A-1B: Effect of treatment with MRX006 on C57Bl/6 mice in the 3-chamber test. $*p<0.05$ novel versus familiar (FIG. 1A) and $**p<0.01$ object versus animal (FIG. 1B).

The compositions of the invention comprise a bacterial strain of the genus Blautia. The examples demonstrate that bacteria of this species are useful for treating or preventing autism spectrum disorders and central nervous system disorders mediated by the microbiota-gut-brain axis. The mouse model experiments used in this application for the assessment of the symptoms of autism spectrum disorders are known in the art to be applicable for the assessment of the symptoms other central nervous system disorders including those listed above The invention provides a composition comprising a bacterial strain of the genus *Blautia* for use in therapy, for example, for use in treating or preventing a central nervous system disorder or condition, in particular a central nervous system disorder or condition mediated by the microbiota-gut-brain axis. In certain embodiments, the compositions of the invention comprise strains of the genus *Blautia* and do not contain any other bacterial genera. In certain embodiments, the compositions of the invention comprise a single strain of the genus *Blautia* and do not contain any other bacterial strains, genera or species.

Examples of *Blautia* strains for use in the invention include *Blautia stercoris, B. faecis, B. coccoides, B. glucerasea, B. hansenii, B. hydrogenotrophica, B. luti, B. producta, B. schinkii* and *B. wexlerae*. Preferred species are *Blautia stercoris, B. wexlerae* and *B. hydrogenotrophica*. The *Blautia* species are Gram-reaction-positive, non-motile bacteria that may be either coccoid or oval and all are obligate anaerobes that produce acetic acid as the major end product of glucose fermentation [26]. *Blautia* may be isolated from the human gut, although *B. producta* was isolated from a septicaemia sample. The GenBank accession number for the 16S rRNA gene sequence of *Blautia stercoris* strain GAM6-1$^T$ is HM626177 (disclosed herein as SEQ ID NO: 1). An exemplary *Blautia stercoris* strain is described in [27]. The type strain of *Blautia wexlerae* is WAL 14507=ATCC BAA-1564=DSM 19850 [28]. The GenBank accession number for the 16S rRNA gene sequence of *Blautia wexlerae* strain WAL 14507 T is EF036467 (disclosed herein as SEQ ID NO: 3). This exemplary *Blautia wexlerae* strain is described in [28].

The *Blautia stercoris* bacterium deposited under accession number NCIMB 42381 was tested in the Examples and is also referred to herein as MRX006 (strain 830). The terms "MRX006", "MRx0006" "Mrx006", "Mrx0006" and strain 830 are used interchangeably herein. A 16S rRNA sequence for MRX006 (830 strain) that was tested is provided in SEQ ID NO: 2. MRX006 (Strain 830) was deposited with the international depositary authority NCIMB, Ltd. (Ferguson Building, Aberdeen, AB21 9YA, Scotland) by GT Biologics Ltd. (Life Sciences Innovation Building, Aberdeen, AB25 2ZS, Scotland) on 12 Mar. 2015 as "*Blautia stercoris* 830" and was assigned accession number NCIMB 42381. GT Biologics Ltd. subsequently changed its name to 4D Pharma Research Limited.

The genome of MRX006 (strain 830) comprises a chromosome and plasmid. A chromosome sequence for MRX006 (strain 830) is provided in SEQ ID NO: 5. A plasmid sequence for MRX006 (strain 830) is provided in SEQ ID NO: 6. These sequences were generated using the PacBio RS II platform.

The *Blautia wexlerae* bacterium deposited under accession number NCIMB 42486 was tested in the Examples and is also referred to herein as strain MRX008. The terms "MRX008", "MRx0008" "Mrx008" and "Mrx0008" are used interchangeably herein. A 16S rRNA sequence for the MRX008 strain that was tested is provided in SEQ ID NO: 4. Strain MRX008 was deposited with the international depositary authority NCIMB, Ltd. (Ferguson Building, Aberdeen, AB21 9YA, Scotland) by 4D Pharma Research Ltd. (Life Sciences Innovation Building, Aberdeen, AB25 2ZS, Scotland) on 16 Nov. 2015 as "Blautia/Ruminococcus" and was assigned accession number NCIMB 42486.

A further preferred strain of the invention is the *Blautia hydrogenotrophica* bacterium deposited under accession number DSM 14294. This strain was deposited with the Deutsche Sammlung von Mikroorganismen [German Microorganism Collection] (Mascheroder Weg 1b, 38124 Braunschweig, Germany) under accession number DSM 14294 as "S5a33" on 10 May 2001. The depositor was INRA Laboratoire de Microbiologie CR de Clermont-Ferrand/Theix 63122 Saint Genes Champanelle, France. Ownership of the deposits has passed to 4D Pharma Plc by way of assignment. 4D Pharma Plc has authorised, by way of an agreement, 4D Pharma Research Limited to refer to the deposited biological material in the application and has given its unreserved and irrevocable consent to the deposited material being made available to the public. The deposit under accession number DSM 14294 was published on 11 May 2000.

The *Blautia hydrogenotrophica* bacterium deposited under accession number DSM 14294 was tested in the Examples and is a preferred strain of the invention.

Bacterial strains closely related to the strain tested in the examples are also expected to be effective for treating or preventing autism spectrum disorders and central nervous system disorders and conditions, in particular central nervous system disorders and conditions mediated by the microbiota-gut-brain axis. In certain embodiments, the bacterial strain for use in the invention has a 16s rRNA sequence that is at least 95%, 96%, 97%, 98%, 99%, 99.5% or 99.9% identical to the 16s rRNA sequence of a bacterial strain of *Blautia stercoris*. Preferably, the bacterial strain for use in the invention has a 16s rRNA sequence that is at least 95%, 96%, 97%, 98%, 99%, 99.5% or 99.9% identical to SEQ ID NO: 1 or 2. Preferably, the sequence identity is to SEQ ID NO: 2. Preferably, the bacterial strain for use in the invention has the 16s rRNA sequence represented by SEQ ID NO: 2. In certain embodiments, the bacterial strain for use in the invention has a 16s rRNA sequence that is at least 95%, 96%, 97%, 98%, 99%, 99.5% or 99.9% identical to the 16s rRNA sequence of a bacterial strain of *Blautia wexlerae*. Preferably, the bacterial strain for use in the invention has a 16s rRNA sequence that is at least 95%, 96%, 97%, 98%, 99%, 99.5% or 99.9% identical to SEQ ID NO: 3 or 4. Preferably, the sequence identity is to SEQ ID NO: 4. Preferably, the bacterial strain for use in the invention has the 16s rRNA sequence represented by SEQ ID NO: 4.

In certain embodiments, the bacterial strain for use in the invention has a chromosome with sequence identity to SEQ ID NO: 5. In preferred embodiments, the bacterial strain for use in the invention has a chromosome with at least 90% sequence identity (e.g. at least 92%, 94%, 95%, 96%, 97%, 98%, 99% or 100% sequence identity) to SEQ ID NO: 5 across at least 60% (e.g. at least 65%, 70%, 75%, 80%, 85%, 95%, 96%, 97%, 98%, 99% or 100%) of SEQ ID NO: 5. For example, the bacterial strain for use in the invention may have a chromosome with at least 90% sequence identity to SEQ ID NO: 5 across 70% of SEQ ID NO: 5, or at least 90% sequence identity to SEQ ID NO: 5 across 80% of SEQ ID NO: 5, or at least 90% sequence identity to SEQ ID NO: 5 across 90% of SEQ ID NO: 5, or at least 90% sequence identity to SEQ ID NO: 5 across 100% of SEQ ID NO: 5, or at least 95% sequence identity to SEQ ID NO: 5 across 70% of SEQ ID NO: 5, or at least 95% sequence identity to SEQ ID NO: 5 across 80% of SEQ ID NO: 5, or at least 95% sequence identity to SEQ ID NO: 5 across 90% of SEQ ID NO: 5, or at least 95% sequence identity to SEQ ID NO: 5 across 100% of SEQ ID NO: 5, or at least 98% sequence identity to SEQ ID NO: 5 across 70% of SEQ ID NO: 5, or at least 98% sequence identity to SEQ ID NO: 5 across 80% of SEQ ID NO: 5, or at least 98% sequence identity to SEQ ID NO: 5 across 90% of SEQ ID NO: 5, or at least 98% sequence identity to SEQ ID NO: 5 across 100% of SEQ ID NO: 5.

In certain embodiments, the bacterial strain for use in the invention has a plasmid with sequence identity to SEQ ID NO: 6. In preferred embodiments, the bacterial strain for use in the invention has a plasmid with at least 90% sequence identity (e.g. at least 92%, 94%, 95%, 96%, 97%, 98%, 99% or 100% sequence identity) to SEQ ID NO: 6 across at least 60% (e.g. at least 65%, 70%, 75%, 80%, 85%, 95%, 96%, 97%, 98%, 99% or 100%) of SEQ ID NO: 6. For example, the bacterial strain for use in the invention may have a plasmid with at least 90% sequence identity to SEQ ID NO: 6 across 70% of SEQ ID NO: 6, or at least 90% sequence identity to SEQ ID NO: 6 across 80% of SEQ ID NO: 6, or at least 90% sequence identity to SEQ ID NO: 6 across 90% of SEQ ID NO: 6, or at least 90% sequence identity to SEQ ID NO: 6 across 100% of SEQ ID NO: 6, or at least 95% sequence identity to SEQ ID NO: 6 across 70% of SEQ ID NO: 6, or at least 95% sequence identity to SEQ ID NO: 6 across 80% of SEQ
ID NO: 6, or at least 95% sequence identity to SEQ ID NO: 6 across 90% of SEQ ID NO: 6, or at least 95% sequence identity to SEQ ID NO: 6 across 100% of SEQ ID NO: 6, or at least 98% sequence identity to SEQ ID NO: 6 across 70% of SEQ ID NO: 6, or at least 98% sequence identity to SEQ ID NO: 6 across 80% of SEQ ID NO: 6, or at least 98% sequence identity to SEQ ID NO: 6 across 90% of SEQ ID NO: 6, or at least 98% sequence identity to SEQ ID NO: 6 across 100% of SEQ ID NO: 6.

In certain embodiments, the bacterial strain for use in the invention has a chromosome with sequence identity to SEQ ID NO: 5 and a plasmid with sequence identity to SEQ ID NO: 6.

Bacterial strains that are biotypes of the bacterium deposited under accession number 42381 are also expected to be effective for treating or preventing autism spectrum disorder and central nervous system disorders and conditions, in particular central nervous system disorders and conditions mediated by the microbiota-gut-brain axis. Bacterial strains that are biotypes of the bacterium deposited under accession number 42486 are also expected to be effective for treating or preventing autism spectrum disorder and central nervous system disorders and conditions, in particular central nervous system disorders and conditions mediated by the microbiota-gut-brain axis. A biotype is a closely related strain that has the same or very similar physiological and biochemical characteristics.

Strains that are biotypes of the bacterium deposited under accession number NCIMB 42381 or 42486 and that are suitable for use in the invention may be identified by sequencing other nucleotide sequences for the bacterium deposited under accession number NCIMB 42381 or 42486. For example, substantially the whole genome may be sequenced and a biotype strain for use in the invention may have at least 95%, 96%, 97%, 98%, 99%, 99.5% or 99.9% sequence identity across at least 80% of its whole genome (e.g. across at least 85%, 90%, 95% or 99%, or across its whole genome). For example, in some embodiments, a biotype strain has at least 98% sequence identity across at least 98% of its genome or at least 99% sequence identity across 99% of its genome. Other suitable sequences for use in identifying biotype strains may include hsp60 or repetitive sequences such as BOX, ERIC, (GTG)$_5$, or REP or [29]. Biotype strains may have sequences with at least 95%, 96%, 97%, 98%, 99%, 99.5% or 99.9% sequence identity to the corresponding sequence of the bacterium deposited under accession number NCIMB 42381 or 42486.

In some embodiments, a biotype strain has a sequence with at least 95%, 96%, 97%, 98%, 99%, 99.5% or 99.9% sequence identity to the corresponding sequence of strain MRX006 deposited as NCIMB 42381 and comprises a 16S rRNA sequence that is at least 99% identical (e.g. at least 99.5% or at least 99.9% identical) to SEQ ID NO: 2. In some embodiments, a biotype strain has a sequence with at least 95%, 96%, 97%, 98%, 99%, 99.5% or 99.9% sequence identity to the corresponding sequence of strain MRX006 deposited as NCIMB 42381 and has the 16S rRNA sequence of SEQ ID NO: 2.

In some embodiments, a biotype strain has a sequence with at least 95%, 96%, 97%, 98%, 99%, 99.5% or 99.9% sequence identity to the corresponding sequence of strain MRX008 deposited as NCIMB 42486 and comprises a 16S rRNA sequence that is at least 99% identical (e.g. at least 99.5% or at least 99.9% identical) to SEQ ID NO: 4. In some embodiments, a biotype strain has a sequence with at least 95%, 96%, 97%, 98%, 99%, 99.5% or 99.9% sequence identity to the corresponding sequence of strain MRX008 deposited as NCIMB 42486 and has the 16S rRNA sequence of SEQ ID NO: 4.

Alternatively, strains that are biotypes of a bacterium deposited under accession number NCIMB 42381 or 42486 and that are suitable for use in the invention may be identified by using the accession number NCIMB 42381 deposit or the accession number NCIMB 42486 deposit, and restriction fragment analysis and/or PCR analysis, for example by using fluorescent amplified fragment length polymorphism (FAFLP) and repetitive DNA element (rep)-PCR fingerprinting, or protein profiling, or partial 16S or 23s rDNA sequencing. In preferred embodiments, such techniques may be used to identify other *Blautia stercoris* or *Blautia wexlerae* strains.

In certain embodiments, strains that are biotypes of a bacterium deposited under accession number NCIMB 42381 or 42486 and that are suitable for use in the invention are strains that provide the same pattern as a bacterium deposited under accession number NCIMB 42381 or 42486 when analysed by amplified ribosomal DNA restriction analysis (ARDRA), for example when using Sau3AI restriction enzyme (for exemplary methods and guidance see, for example,[30]). Alternatively, biotype strains are identified as strains that have the same carbohydrate fermentation patterns as a bacterium deposited under accession number NCIMB 42381 or 42486.

Other *Blautia stercoris* strains that are useful in the compositions and methods of the invention, such as biotypes of the bacterium deposited under accession number NCIMB 42381 or 42486, may be identified using any appropriate method or strategy, including the assays described in the examples. For instance, strains for use in the invention may be identified by culturing in anaerobic YCFA and/or administering the bacteria to an autism spectrum disorder mouse model and then assessing cytokine levels. In particular, bacterial strains that have similar growth patterns, metabolic type and/or surface antigens to the bacterium deposited under accession number NCIMB 42381 or 42486 may be useful in the invention. A useful strain will have comparable immune modulatory activity to the NCIMB 42381 or 42486 strain. In particular, a biotype strain will elicit comparable effects on the autism spectrum disorder models to the effects shown in the Examples, which may be identified by using the culturing and administration protocols described in the Examples.

A particularly preferred strain of the invention is the *Blautia stercoris* strain deposited under accession number NCIMB 42381. This is the exemplary MRX006 strain tested in the examples and shown to be effective for treating disease. Therefore, the invention provides a cell, such as an isolated cell, of the Blautia stercoris strain deposited under accession number NCIMB 42381, or a derivative thereof. The invention also provides a composition comprising a cell of the *Blautia stercoris* strain deposited under accession number NCIMB 42381, or a derivative thereof. The invention also provides a biologically pure culture of the *Blautia stercoris* strain deposited under accession number NCIMB 42381. The invention also provides a cell of the *Blautia stercoris* strain deposited under accession number NCIMB 42381, or a derivative thereof, for use in therapy, in particular for the diseases described herein.

A particularly preferred strain of the invention is the *Blautia wexlerae* strain deposited under accession number NCIMB 42486. This is the exemplary MRX008 strain tested in the examples and shown to be effective for treating disease. Therefore, the invention provides a cell, such as an isolated cell, of the *Blautia wexlerae* strain deposited under accession number NCIMB 42486, or a derivative thereof. The invention also provides a composition comprising a cell of the *Blautia wexlerae* strain deposited under accession number NCIMB 42486, or a derivative thereof. The invention also provides a biologically pure culture of the *Blautia wexlerae* strain deposited under accession number NCIMB 42486. The invention also provides a cell of the *Blautia wexlerae* strain deposited under accession number NCIMB 42486, or a derivative thereof, for use in therapy, in particular for the diseases described herein.

A derivative of the strain deposited under accession number NCIMB 42381 or 42486 may be a daughter strain (progeny) or a strain cultured (subcloned) from the original. A derivative of the strain deposited under accession number NCIMB 42381 or 42486 may be a daughter strain (progeny) or a strain cultured (subcloned) from the original. A derivative of a strain of the invention may be modified, for example at the genetic level, without ablating the biological activity. In particular, a derivative strain of the invention is therapeutically active. A derivative strain will have comparable immune modulatory activity to the original NCIMB 42381 or 42486 strain. In particular, a derivative strain will elicit comparable effects on the central nervous system disorder or condition models and comparable effects on cytokine levels to the effects shown in the Examples, which may be identified by using the culturing and administration protocols described in the Examples. A derivative of the NCIMB 42381 strain will generally be a biotype of the NCIMB 42381 strain. A derivative of the NCIMB 42486 strain will generally be a biotype of the NCIMB 42486 strain.

References to cells of the *Blautia stercoris* strain deposited under accession number NCIMB 42381 encompass any cells that have the same safety and therapeutic efficacy characteristics as the strains deposited under accession number NCIMB 42381, and such cells are encompassed by the invention. Thus, in some embodiments, reference to cells of the *Blautia stercoris* strain deposited under accession number NCIMB 42381 refers only to the MRX006 strain deposited under NCIMB 42381 and does not refer to a bacterial strain that was not deposited under NCIMB 42381. In some embodiments, reference to cells of the *Blautia stercoris* strain deposited under accession number NCIMB 42381 refers to cells that have the same safety and therapeutic efficacy characteristics as the strains deposited under accession number NCIMB 42381, but which are not the strain deposited under NCIMB 42381.

References to cells of the *Blautia wexlerae* strain deposited under accession number NCIMB 42486 encompass any cells that have the same safety and therapeutic efficacy characteristics as the strains deposited under accession number NCIMB 42486, and such cells are encompassed by the invention. Thus, in some embodiments, reference to cells of the *Blautia wexlerae* strain deposited under accession number NCIMB 42486 refers only to the strain deposited under NCIMB 42486 and does not refer to a bacterial strain that was not deposited under NCIMB 42486. In some embodiments, reference to cells of the *Blautia wexlerae* strain deposited under accession number NCIMB 42486 refers to cells that have the same safety and therapeutic efficacy characteristics as the strains deposited under accession number NCIMB 42486, but which are not the strain deposited under NCIMB 42486.

In certain embodiments, the bacterial strain for use in the invention has a chromosome with sequence identity to SEQ ID NO: 5, for example as described above, and a 16S rRNA sequence with sequence identity to SEQ ID NO: 1, 2, 3 or 4, for example as described above, preferably with a 16s rRNA sequence that is at least 99% identical to SEQ ID NO: 2 or 4, more preferably which comprises the 16S rRNA sequence of SEQ ID NO: 2 or 4.

In certain embodiments, the bacterial strain for use in the invention has a chromosome with sequence identity to SEQ ID NO: 5, for example as described above, and is effective for treating or preventing central nervous system disorders and conditions, in particular central nervous system disorders and conditions mediated by the microbiota-gut-brain axis.

In certain embodiments, the bacterial strain for use in the invention has a chromosome with sequence identity to SEQ ID NO: 5, for example as described above, and a 16S rRNA sequence with sequence identity to SEQ ID NO: 1, 2, 3 or 4, for example as described above, and is effective for treating or preventing central nervous system disorders and conditions, in particular central nervous system disorders and conditions mediated by the microbiota-gut-brain axis.

In certain embodiments, the bacterial strain for use in the invention has a 16s rRNA sequence that is at least 99%, 99.5% or 99.9% identical to the 16s rRNA sequence represented by SEQ ID NO: 2 or 4 (for example, which comprises the 16S rRNA sequence of SEQ ID NO: 2 or 4) and a chromosome with at least 95% sequence identity to SEQ ID NO: 5 across at least 90% of SEQ ID NO: 5, and which is effective for treating or preventing central nervous system disorders and conditions, in particular central nervous system disorders and conditions mediated by the microbiota-gut-brain axis.

In certain embodiments, the bacterial strain for use in the invention is a *Blautia stercoris* and has a 16s rRNA sequence that is at least 99%, 99.5% or 99.9% identical to the 16s rRNA sequence represented by SEQ ID NO: 2 or 4 (for example, which comprises the 16S rRNA sequence of SEQ ID NO: 2 or 4) and a chromosome with at least 98% sequence identity (e.g. at least 99% or at least 99.5% sequence identity) to SEQ ID NO: 5 across at least 98% (e.g. across at least 99% or at least 99.5%) of SEQ ID NO: 5, and which is effective for treating or preventing central nervous system disorders and conditions, in particular central nervous system disorders and conditions mediated by the microbiota-gut-brain axis.

In certain embodiments, the bacterial strain for use in the invention has a plasmid with sequence identity to SEQ ID NO: 6, for example as described above, and a 16S rRNA sequence with sequence identity to SEQ ID NO: 1, 2, 3 or 4, for example as described above, preferably with a 16s rRNA sequence that is at least 99% identical to SEQ ID NO: 2 or 4, more preferably which comprises the 16S rRNA sequence of SEQ ID NO: 2 or 4.

In certain embodiments, the bacterial strain for use in the invention has a plasmid with sequence identity to SEQ ID NO: 6, for example as described above, and is effective for treating or preventing central nervous system disorders and conditions, in particular central nervous system disorders and conditions mediated by the microbiota-gut-brain axis.

In certain embodiments, the bacterial strain for use in the invention has a plasmid with sequence identity to SEQ ID NO: 6, for example as described above, and a 16S rRNA sequence with sequence identity to SEQ ID NO: 1, 2, 3 or 4, for example as described above, and is effective for treating or preventing central nervous system disorders and conditions, in particular central nervous system disorders and conditions mediated by the microbiota-gut-brain axis.

In certain embodiments, the bacterial strain for use in the invention has a 16s rRNA sequence that is at least 99%, 99.5% or 99.9% identical to the 16s rRNA sequence represented by SEQ ID NO: 2 or 4 (for example, which comprises the 16S rRNA sequence of SEQ ID NO: 2 or 4) and a plasmid with at least 95% sequence identity to SEQ ID NO: 6 across at least 90% of SEQ ID NO: 6, and which is effective for treating or preventing central nervous system disorders and conditions, in particular central nervous system disorders and conditions mediated by the microbiota-gut-brain axis.

In certain embodiments, the bacterial strain for use in the invention is a *Blautia stercoris* and has a 16s rRNA sequence that is at least 99%, 99.5% or 99.9% identical to the 16s rRNA sequence represented by SEQ ID NO: 2 or 4 (for example, which comprises the 16S rRNA sequence of SEQ ID NO: 2 or 4) and a plasmid with at least 98% sequence identity (e.g. at least 99% or at least 99.5% sequence identity) to SEQ ID NO: 6 across at least 98% (e.g. across at least 99% or at least 99.5%) of SEQ ID NO: 6, and which is effective for treating or preventing central nervous system disorders and conditions, in particular central nervous system disorders and conditions mediated by the microbiota-gut-brain axis.

In certain embodiments, the bacterial strain for use in the invention has a chromosome with sequence identity to SEQ ID NO: 5, for example as described above, a plasmid with sequence identity to SEQ ID NO: 6, for example as described above, and a 16S rRNA sequence with sequence identity to SEQ ID NO: 1, 2, 3 or 4, for example as described above, preferably with a 16s rRNA sequence that is at least 99% identical to SEQ ID NO: 2 or 4, more preferably which comprises the 16S rRNA sequence of SEQ ID NO: 2 or 4.

In certain embodiments, the bacterial strain for use in the invention has a chromosome with sequence identity to SEQ ID NO: 5, for example as described above, and a plasmid with sequence identity to SEQ ID NO: 6, for example as described above, and is effective for treating or preventing central nervous system disorders and conditions, in particular central nervous system disorders and conditions mediated by the microbiota-gut-brain axis.

In certain embodiments, the bacterial strain for use in the invention has a chromosome with sequence identity to SEQ ID NO: 5, for example as described above, a plasmid with sequence identity to SEQ ID NO: 6, for example as described above, and a 16S rRNA sequence with sequence identity to SEQ ID NO: 1, 2, 3 or 4, for example as described above, and is effective for treating or preventing central nervous system disorders and conditions, in particular central nervous system disorders and conditions mediated by the microbiota-gut-brain axis.

In certain embodiments, the bacterial strain for use in the invention has a 16s rRNA sequence that is at least 99%, 99.5% or 99.9% identical to the 16s rRNA sequence represented by SEQ ID NO: 2 or 4 (for example, which comprises the 16S rRNA sequence of SEQ ID NO: 2 or 4), a chromosome with at least 95% sequence identity to SEQ ID NO: 5 across at least 90% of SEQ ID NO: 5, and a plasmid at least 95% sequence identity to SEQ ID NO: 6 across at least 90% of SEQ ID NO: 6, and which is effective for treating or preventing central nervous system disorders and conditions, in particular central nervous system disorders and conditions mediated by the microbiota-gut-brain axis.

In certain embodiments, the bacterial strain for use in the invention is a *Blautia stercoris* and has a 16s rRNA sequence that is at least 99%, 99.5% or 99.9% identical to the 16s rRNA sequence represented by SEQ ID NO: 2 or 4 (for example, which comprises the 16S rRNA sequence of SEQ ID NO: 2 or 4), a chromosome with at least 98% sequence identity (e.g. at least 99% or at least 99.5% sequence identity) to SEQ ID NO: 5 across at least 98% (e.g. across at least 99% or at least 99.5%) of SEQ ID NO: 5, and a plasmid with at least 98% sequence identity (e.g. at least 99% or at least 99.5% sequence identity) to SEQ ID NO: 6 across at least 98% (e.g. across at least 99% or at least 99.5%) of SEQ ID NO: 6, and which is effective for treating or preventing central nervous system disorders and conditions, in particular central nervous system disorders and conditions mediated by the microbiota-gut-brain axis.

In preferred embodiments, the bacterial strains in the compositions of the invention are viable and capable of partially or totally colonising the intestine.

*Blautia hydrogenotrophica* (previously known as *Ruminococcus hydrogenotrophicus*) has been isolated from the guts of mammals, is strictly anaerobic, and metabolises $H_2/CO_2$ to acetate, which may be important for human nutrition and health. The type strain of *Blautia hydrogenotrophica* is S5a33=JCM 14656. The GenBank accession number for the 16S rRNA gene sequence of *Blautia hydrogenotrophica* strain S5a36 is X95624.1 (disclosed herein as SEQ ID NO: 7). This exemplary *Blautia hydrogenotrophica* strain is described in [28] and [31]. The S5a33 strain and the S5a36 strain correspond to two subclones of a strain isolated from a faecal sample of a healthy subject. They show identical morphology, physiology and metabolism and have identical 16S rRNA sequences. Thus, in some embodiments, the *Blautia hydrogenotrophica* for use in the invention has the 16S rRNA sequence of SEQ ID NO: 7.

In certain embodiments, the bacterial strain for use in the invention has a 16s rRNA sequence that is at least 95%, 96%, 97%, 98%, 99%, 99.5% or 99.9% identical to the 16s rRNA sequence of a bacterial strain of *Blautia hydrogenotrophica*. Preferably, the bacterial strain for use in the invention has a 16s rRNA sequence that is at least 95%, 96%, 97%, 98%, 99%, 99.5% or 99.9% identical to SEQ ID NO: 7. Preferably, the bacterial strain for use in the invention has the 16s rRNA sequence represented by SEQ ID NO: 7.

Bacterial strains that are biotypes of the bacterium deposited under accession number DSM 14294 are also expected to be effective for treating or preventing autism spectrum disorder and central nervous system disorders and conditions, in particular central nervous system disorders and conditions mediated by the microbiota-gut-brain axis.

Strains that are biotypes of the bacterium deposited under accession number DSM 14294 and that are suitable for use in the invention may be identified by sequencing other nucleotide sequences for the bacterium deposited under accession number DSM 14294. For example, substantially the whole genome may be sequenced and a biotype strain for use in the invention may have at least 95%, 96%, 97%, 98%, 99%, 99.5% or 99.9% sequence identity across at least 80% of its whole genome (e.g. across at least 85%, 90%, 95% or 99%, or across its whole genome). For example, in some embodiments, a biotype strain has at least 98% sequence identity across at least 98% of its genome or at least 99% sequence identity across 99% of its genome. Other suitable sequences for use in identifying biotype strains may include hsp60 or repetitive sequences such as BOX, ERIC, $(GTG)_5$, or REP or [29]. Biotype strains may have sequences with at least 95%, 96%, 97%, 98%, 99%, 99.5% or 99.9% sequence identity to the corresponding sequence of the bacterium deposited under accession number DSM 14294.

In some embodiments, a biotype strain has a sequence with at least 95%, 96%, 97%, 98%, 99%, 99.5% or 99.9% sequence identity to the corresponding sequence of the strain deposited as accession number DSM 14294 and comprises a 16S rRNA sequence that is at least 99% identical (e.g. at least 99.5% or at least 99.9% identical) to SEQ ID NO: 7. In some embodiments, a biotype strain has a sequence with at least 95%, 96%, 97%, 98%, 99%, 99.5% or 99.9% sequence identity to the corresponding sequence of the strain deposited as accession number DSM 14294 and has the 16S rRNA sequence of SEQ ID NO: 7.

Alternatively, strains that are biotypes of a bacterium deposited under accession number DSM 14294 and that are suitable for use in the invention may be identified by using the accession number DSM 14294 deposit, and restriction fragment analysis and/or PCR analysis, for example by using fluorescent amplified fragment length polymorphism (FAFLP) and repetitive DNA element (rep)-PCR fingerprinting, or protein profiling, or partial 16S or 23s rDNA sequencing. In preferred embodiments, such techniques may be used to identify other *Blautia hydrogenotrophica* strains.

In certain embodiments, strains that are biotypes of a bacterium deposited under accession number NCIMB 42381 or 42486 and that are suitable for use in the invention are strains that provide the same pattern as a bacterium deposited under accession number DSM 14294 when analysed by amplified ribosomal DNA restriction analysis (ARDRA), for example when using Sau3AI restriction enzyme (for exemplary methods and guidance see, for example, [30]). Alternatively, biotype strains are identified as strains that have the same carbohydrate fermentation patterns as a bacterium deposited under accession number DSM 14294.

Other *Blautia hydrogenotrophica* strains that are useful in the compositions and methods of the invention, such as biotypes of the bacterium deposited under accession number DSM 14294, may be identified using any appropriate method or strategy, including the assays described in the examples. For instance, strains for use in the invention may be identified by culturing in anaerobic YCFA and/or administering the bacteria to an autism spectrum disorder mouse model and then assessing cytokine levels. In particular, bacterial strains that have similar growth patterns, metabolic type and/or surface antigens to the bacterium deposited under accession number DSM 14294 may be useful in the invention. A useful strain will have comparable immune modulatory activity to the accession number DSM 14294 strain. In particular, a biotype strain will elicit comparable effects on the autism spectrum disorder models to the effects shown in the Examples, which may be identified by using the culturing and administration protocols described in the Examples.

A particularly preferred strain of the invention is the *Blautia hydrogenotrophica* strain deposited under accession number DSM 14294. This is the exemplary strain tested in the examples and shown to be effective for treating disease. Therefore, the invention provides a cell, such as an isolated cell, of the *Blautia hydrogenotrophica* strain deposited under accession number DSM 14294, or a derivative thereof. The invention also provides a composition comprising a cell of the *Blautia hydrogenotrophica* strain deposited under accession number DSM 14294, or a derivative thereof. The invention also provides a biologically pure culture of the *Blautia hydrogenotrophica* strain deposited under accession number DSM 14294. The invention also provides a cell of the *Blautia hydrogenotrophica* strain deposited under accession number DSM 14294, or a derivative thereof, for use in therapy, in particular for the diseases described herein.

A derivative of the strain deposited under accession number DSM 14294 may be a daughter strain (progeny) or a strain cultured (subcloned) from the original. A derivative of the strain deposited under accession number DSM 14294 may be a daughter strain (progeny) or a strain cultured (subcloned) from the original. A derivative of a strain of the invention may be modified, for example at the genetic level, without ablating the biological activity. In particular, a derivative strain of the invention is therapeutically active. A derivative strain will have comparable immune modulatory activity to the original strain deposited under accession number DSM 14294. In particular, a derivative strain will elicit comparable effects on the central nervous system disorder or condition models and comparable effects on cytokine levels to the effects shown in the Examples, which may be identified by using the culturing and administration protocols described in the Examples. A derivative of the DSM 14294 strain will generally be a biotype of the DSM 14294 strain.

References to cells of the *Blautia hydrogenotrophica* strain deposited under accession number DSM 14294 encompass any cells that have the same safety and therapeutic efficacy characteristics as the strains deposited under accession number DSM 14294, and such cells are encompassed by the invention. Thus, in some embodiments, reference to cells of the *Blautia hydrogenotrophica* strain deposited under accession number DSM 14294 refers only to the strain deposited under DSM 14294 and does not refer to a bacterial strain that was not deposited under DSM 14294. In some embodiments, reference to cells of the *Blautia hydrogenotrophica* strain deposited under accession number DSM 14294 refers to cells that have the same safety and therapeutic efficacy characteristics as the strains deposited under accession number DSM 14294, but which are not the strain deposited under DSM 14294.

In preferred embodiments, the bacterial strains in the compositions of the invention are viable and capable of partially or totally colonising the intestine.

Therapeutic Uses

Modulation of the Microbiota-Gut-Brain Axis

Communication between the gut and the brain (the microbiota-gut-brain axis) occurs via a bidirectional neurohumoral communication system. Recent evidence shows that the microbiota that resides in the gut can modulate brain development and produce behavioural phenotypes via the microbiota-gut-brain axis. Indeed, a number of reviews suggest a role of the microbiota-gut-brain axis in maintaining central nervous system functionality and implicate dysfunction of the microbiota-gut-brain axis in the development of central nervous system disorders and conditions [10],[13], [14],[32].

The bidirectional communication between the brain and the gut (i.e. the-gut-brain axis) includes the central nervous system, neuroendocrine and neuroimmune systems, including the hypothalamus-pituitary-adrenal (HPA) axis, sympathetic and parasympathetic arms of the autonomic nervous system (ANS), including the enteric nervous system (ENS) and the vagus nerve, and the gut microbiota.

As demonstrated in the examples, the compositions of the present invention can modulate the microbiota-gut-brain axis and reduce behavioural symptoms associated with a CNS disorder. Accordingly, the compositions of the invention may be useful for treating or preventing disorders of the central nervous system (CNS), in particular those disorders and conditions associated with dysfunction of the microbiota-gut-brain axis.

The compositions of the invention may also be useful for treating or preventing neurodevelopmental disorders and/or neuropsychiatric conditions. Neurodevelopmental diseases and neuropsychiatric conditions are often associated with the microbiota-gut-brain axis. The compositions of the invention may be useful for treating or preventing neurodevelopmental diseases and/or neuropsychiatric conditions mediated by dysfunction of the microbiota-gut-brain axis. In further preferred embodiments, the compositions of the invention are for use in treating or preventing a neurodevelopmental disorder or a neuropsychiatric condition.

In particular embodiments, the compositions of the invention may be useful for treating or preventing a disease or condition selected from the group consisting of: autism spectrum disorders (ASDs); child developmental disorder; obsessive compulsive disorder (OCD); major depressive disorder; depression; seasonal affective disorder; anxiety disorders; schizophrenia spectrum disorders; schizophrenia; bipolar disorder; psychosis; mood disorder; chronic fatigue syndrome (myalgic encephalomyelitis); stress disorder; post-traumatic stress disorder; dementia; Alzheimer's; Parkinson's disease; and/or chronic pain. In further embodiments, the compositions of the invention may be useful for treating or preventing motor neuron disease; Huntington's disease; Guillain-Barre syndrome and/or meningitis.

The compositions of the invention may be particularly useful for treating or preventing chronic disease, treating or preventing disease in patients that have not responded to other therapies (such as treatment with anti-psychotics and/or anti-depressants), and/or treating or preventing the tissue damage and symptoms associated with dysfunction of the microbiota-gut-brain axis.

In certain embodiments, the compositions of the invention modulate the CNS. In some embodiments, the compositions of the invention modulate the autonomic nervous system (ANS). In some embodiments, the compositions of the invention modulate the enteric nervous system (ENS). In some embodiments, the compositions of the invention modulate the hypothalamic, pituitary, adrenal (HPA) axis. In some embodiments, the compositions of the invention modulate the neuroendocrine pathway. In some embodiments, the compositions of the invention modulate the neuroimmune pathway. In some embodiments, the compositions of the invention modulate the CNS, the ANS, the ENS, the HPA axis and/or the neuroendocrine and neuroimmune pathways. In certain embodiments, the compositions of the invention module the levels of commensal metabolites and/or the gastrointestinal permeability of a subject.

The signalling of the microbiota-gut-brain axis is modulated by neural systems. Accordingly, in some embodiments, the compositions of the invention modulate signalling in neural systems. In certain embodiments, the compositions of the invention modulate the signalling of the central nervous system. In some embodiments, the compositions of the invention modulate signalling in sensory neurons. In other embodiments, the compositions of the invention modulate signalling in motor neurons. In some embodiments, the compositions of the invention modulate the signalling in the ANS. In some embodiments, the ANS is the parasympathetic nervous system. In preferred embodiments, the compositions of the invention modulate the signalling of the vagus nerve. In other embodiments, the ANS is the sympathetic nervous system. In other embodiments, the compositions of the invention modulate the signalling in the enteric nervous system. In certain embodiments, the signalling of ANS and ENS neurons responds directly to luminal contents of the gastrointestinal tract. In other embodiments, the signalling of ANS and ENS neurons responds indirectly to neurochemicals produced by luminal bacteria. In other embodiments, the signalling of ANS and ENS neurons responds to neurochemicals produced by luminal bacteria or enteroendocrine cells. In certain preferred embodiments, the neurons of the ENS activate vagal afferents that influence the functions of the CNS. In some embodiments, the compositions of the invention regulate the activity of enterochromaffin cells.

In certain embodiments, the compositions of the invention modulate fear conditioning in an animal model. In certain embodiments, the compositions of the invention can be used to modulate the development of fear and/or anxiety, and/or modulate the extent to which the fear and/or anxiety becomes extinct in a subject. In certain embodiments, the compositions of the invention can be used to modulate the extent of stress-induced hyperthermia in an animal model. In certain embodiments, the compositions of the invention modulate the level of stress and/or anxiety in a subject.

Autism Spectrum Disorder (ASD)

Autism spectrum disorder is a set of heterogeneous neurodevelopmental conditions, characterised by early-onset difficulties in social interaction, communication and unusually restricted, repetitive behaviour and interests. Symptoms can be recognised from a very early age but ASD is often diagnosed in more able children starting mainstream education. Autism represents the primary type of ASD.

Historically, autism has been diagnosed on the basis of three core domains: impaired social interaction, abnormal communication, and restricted and repetitive behaviours and interests. In the International Classification of Diseases (ICD-10R, WHO 1993) and the Diagnostic and Statistical Manual (DSM-IV, American Psychiatric Association, 2000), autism comes under the umbrella term of Pervasive Developmental Disorder (PDD), with four possible diagnostic subtypes: Asperger Syndrome, Childhood Autism/Autistic Disorder, Atyptical Autism, and PDD—not otherwise specified. In DMS-5, these diagnostic subtypes are combined into a single category of autism spectrum disorder (ASD) and the previous use of three core domains of impairment has been reduced to two main areas, namely social communication and interaction, and repetitive behaviour, which include sensory integration dysfunctions.

ASD is a 'spectrum disorder' as it affects each person in a variety of different ways and can range from very mild to severe. The functioning of the affected individual varies substantially depending on language abilities, level of intelligence, co-morbidity, composition of symptoms and access to services. Cognitive functioning, learning, attention and sensory processing are usually impaired.

DSM-IV states that the diagnosis of autism requires the presence of at least six symptoms, including a minimum of two measures of qualitative impairment in social interaction, one symptom of qualitative impairment in communication, and one symptom of restricted and repetitive behaviour. DMS-5 redefines diagnosis of ASD into two symptom domains: (i) social interaction and social communication deficits; and (ii) restricted, repetitive patterns of behaviour, interests or activities.

Co-morbid medical conditions are highly prevalent in ASDs. Co-morbid include anxiety and depression, seizures, attention deficits, aggressive behaviours, sleep problems, gastrointestinal disorders, epilepsy, mental retardation, intellectual disabilities and feeding difficulties.

The examples demonstrate that the compositions of the invention achieve a reduction in disease incidence and disease severity in an animal model of autism spectrum disorder and so they may be useful in the treatment or prevention of autism spectrum disorders.

ASD is a central nervous system disorder that is partially triggered by environmental factors. Therefore, dysfunction of the microbiota-gut-brain axis may be responsible for development and persistence of ASDs. Accordingly, in preferred embodiments, the composition of the invention are for use in treating or preventing autism spectrum disorders. In some embodiments, the compositions of the invention are for use in treating or preventing autism. In some embodiments, the autism is Pervasive Developmental Disorder (PDD). In another embodiment, the PDD is Asperger Syndrome, Childhood Autism/Autistic Disorder, Atypical Autism and/or PDD—not otherwise specified. Accordingly, in some embodiments, the compositions of the invention are for use in treating or preventing autism spectrum disorders, autism, pervasive developmental disorder; Asperger Syndrome; Childhood Autism/Autistic Disorder, Atypical Autism and/or PDD—not otherwise specified.

The compositions of the invention may be useful for modulating the microbiota-gut-brain axis of a subject. Accordingly, in preferred embodiments the compositions of the invention are for use in preventing an ASD in a patient that has been identified as at risk of an ASD, or that has been diagnosed with an ASD at a prenatal or an early developmental stage; in childhood and/or in adulthood. The compositions of the invention may be useful for preventing the development of ASDs.

The compositions of the invention may be useful for managing or alleviating ASDs. Treatment or prevention of ASDs may refer to, for example, an alleviation of the severity of symptoms or a reduction in the frequency of exacerbations or the range of triggers that are a problem for the patient.

In preferred embodiments, the compositions of the invention prevent, reduce or alleviate at least one core symptom of ASDs.

In some embodiments, the compositions of the invention prevent, reduce or alleviate at least one of the two symptom domains of ASD classified in the DMS-5. In some embodiments, the compositions of the invention prevent, reduce or alleviate social interaction and/or social communication deficits. In some embodiments, the compositions of the invention prevent, reduce or alleviate restrictive, repetitive patterns of behaviour, interests or activities. In some embodiments, the compositions of the invention prevent, reduce or alleviate social interaction, social communication deficits and/or restrictive, repetitive patterns of behaviour, interests or activities.

In some embodiments, the compositions of the invention prevent, reduce or alleviate repetitive behaviour, stereotyped behaviour, compulsive behaviour, routine behaviour, sameness behaviour and restricted behaviour. In some embodiments, the compositions of the invention improve social awareness, social information processing, capacity for social communication, social anxiety/avoidance, and autistic preoccupations and traits in a subject with ASDs.

In some embodiments, the compositions of the invention prevent, reduce or alleviate additional symptoms associated with the core symptoms of ASDs. In some embodiments, the compositions of the invention prevent, reduce or alleviate irritability (including aggression, deliberate self-injury and temper tantrums), agitation, crying, lethargy, social withdrawal, stereotypic behaviour, hyperactivity, non-compliance, inappropriate speech, anxiety, depression, and/or over or under-controlled behaviour in a subject with ASDs. In some embodiments, the compositions of the invention improve cognitive functioning, learning, attention and/or sensory processing in a subject with ASD.

In other embodiments, the compositions of the invention improve secondary outcome measures in a subject with ASDs. In some embodiments, the secondary outcome measures include additional symptom and/or functional rating scales, behavioural scales and miscellaneous measures of interest.

In some embodiments, the compositions of the invention cause in a positive change in the diagnostic and/or symptomatic scale for the assessment of core symptoms of a subject with ASDs. In some embodiments, the diagnostic and/or symptomatic scale is the Autism Diagnostic Interview—Revised (ASI-R). In some embodiments, the diagnostic or symptomatic scale is the Autism Diagnostic Observation Schedule-Generic (ADOS-G) now ADOS-2. In other embodiments, the diagnostic or symptomatic scale is the Autism Diagnostic Interview Revised (ADI-R). In other embodiments, the diagnostic or symptomatic scale is the Diagnostic Interview for Social and Communication Disorders (DISCO). In yet other embodiments, the diagnostic or symptomatic scale is the Childhood Autism Rating Scale (CARS and CARS2).

In some embodiments, the compositions of the invention cause a positive change in generic measures of the efficacy endpoints of ASDs. In certain embodiments, the generic measures include, but are not limited to the Aberrant Behaviour Checklist (ABC), the Child Behaviour Checklist (CBCL), the Vineland-II Adaptive Behaviour Scales (VABS), the Social Responsiveness Scale (SRS), and/or the Repetitive Behaviour Scale—Revised (RBS-R).

In some embodiments, the compositions of the invention improve the Clinical Global Impression-Global Improvement (CGI-I) scale for assessing psychiatric and neurological disorders. In some embodiments, the compositions of the invention display a positive effect on global functioning of the subject with ASDs.

Additional scales would be known to a person skilled in the art. In some embodiments, the compositions of the invention would improve the outcome of diagnostic and/or symptomatic scales known to a person skilled in the art.

In certain embodiments, the compositions of the invention prevent, reduce or alleviate the incidence of comorbidities of ASDs. In some embodiments, the compositions of the invention prevent, reduce or alleviate the incidence of anxiety and depression, seizures, attention deficits, aggressive behaviours, sleep problems, gastrointestinal disorders (including irritable bowel syndrome (IBS)), epilepsy, mental retardation, intellectual disabilities and/or feeding difficulties. In certain embodiments, the compositions of the invention prevent, reduce or alleviate gastrointestinal comorbidities, such as abdominal pain, diarrhoea and flatulence.

In some embodiments, the compositions of the invention prevent, reduce or alleviate the symptoms of certain psychiatric and behavioural disorders that may present clinically with similarities to autism. Accordingly, in some embodiments, the compositions of the invention, prevent, reduce or alleviate attention deficit disorder (ADHD); affective/anxiety disorders; attachment disorders; oppositional defiant disorder (ODD); obsessive compulsive disorder (OCD) and/or psychoses including schizophrenia (cognitive impairment).

In some embodiments, the compositions of the invention are particularly effective at preventing, reducing or alleviating ASDs when used in combination with another therapy for treating ASDs. Such therapies include anti-psychotic, anti-anxiety and anti-depressant drugs. Such drugs include risperidone (Risperdal®); olanzapine (Zyprexa®); fluoxetine (Prozac®); sertraline (Zoloft®); fluvoxamine (Luvox®); clomipramine (Anafranil®); haloperidol (Haldol®); thioridazine; fluphenazine; chlorpromazine; ziprasidone (Geogon®); carbamazepine (Tegretol®); lamotrigine (Lamictal®); topiramate (Topomax®); valproic acid (Depakote®); methylphenidate (Ritalin®); diazepam (Valium®) and lorazepam (Ativan®).

The EMA Guidelines on the clinical development of medicinal products for the treatment of autism spectrum disorder state that, due to the heterogeneity of the diseases, it may not be possible to achieve a significant effect on all core symptoms with a single compound, and so short term efficacy has to be demonstrated on at least one core symptom. The live biotherapeutic strains used in the Examples have shown effective treatment of at least one core symptom of autistic spectrum disorder, so these strains and related *Blautia* strains are expected to be effective against human disease.

Obsessive Compulsive Disorder (OCD)

OCD is a heterogeneous, chronic and disabling disorder belonging to the anxiety disorders. According to the DSM-IV definition, the essential features of OCD are recurrent obsessions and/or compulsions (criterion A) that are severe and time consuming (more than one hour a day) or cause marked distress or significantly interfere with the subject's normal routine, occupational functioning, usual social activities or relationships (criterion C). As some point during the course of the disorder, the person has recognised that the obsessions or compulsions are excessive or unreasonable (criterion B).

Obsessions are defined as recurrent and persistent thoughts, impulses or images that are experienced as intrusive and inappropriate and cause marked anxiety or distress. The thoughts, impulses or images are not simply excessive worries about real-life problems, they are recognised by the patient as a product of his own mind (e.g. fear for contamination, symmetry obsession). The person attempts to ignore, suppress or neutralise the obsessions with some other thoughts or actions.

Compulsions are defined as repetitive behaviours (e.g. hand washing, ordering, hoarding, checking) or mental acts (e.g. praying, counting, repeating words silently) that the person feels driven to perform in response to an obsession or according to rules that must be applied rigidly.

OCD is often associated with co-morbidity rates of other psychiatric diseases including major depressive disorder, other anxiety disorders (generalised anxiety disorder, social anxiety disorder, panic disorder), substance abuse and eating disorders (anorexia and bulimia).

OCD is a psychiatric disorder that may develop or persist due to dysfunction of the microbiota-gut-brain axis. Accordingly, in preferred embodiments, the compositions of the invention are for use in treating or preventing OCD in a subject.

In certain embodiments, the compositions of the invention prevent, reduce or alleviate the essential symptomatic features of OCD. In certain embodiments, the compositions of the invention prevent, reduce or alleviate recurrent obsessions and/or compulsions in a subject. In certain embodiments, the obsessions are recurrent or persistent thoughts, impulses or images that are experiences as intrusive and inappropriate and cause marked anxiety or distress. In certain embodiments, the compulsions are repetitive behaviours that the subject feels driven to perform in response to an obsession or according to rules that must be applied rigidly.

In certain embodiments, the compositions of the invention improve symptoms of OCD in a subject accordingly to the Y-BOCS and/or the NIMH-OC diagnostic and/or symptomatic scales. In some embodiments, the Y-BOCS scale is used to monitor improvement of primary endpoints. In some embodiments, the NIMH-OC scale is used to monitor improvement of secondary parameters.

In some embodiments, the compositions of the invention improve the Clinical Global Impression—Global Improvement (CGI-I) scale for assessing psychiatric and neurological disorders. In some embodiments, the compositions of the invention display a positive effect on global social functioning (relationships, work, etc.) of the subject with ASDs. In some embodiments, the global scale is the Sheehan disability scale.

In preferred embodiments, the compositions of the invention prevent, reduce or alleviate at least one comorbidity of OCD. The comorbidities of OCD include major depressive disorder, other anxiety disorders (generalised anxiety disorder, social anxiety disorder, panic disorder), substance abuse and eating disorders (anorexia and bulimia) Gilles de la Tourette syndrome, ADHD (Attention-Deficit/Hyperactivity Disorder) and developmental disorders.

In some embodiments, the compositions of the invention are particularly effective at preventing, reducing or alleviating OCD when used in combination with another therapy for treating OCD. Such therapies include serotonin and dopamine reuptake inhibitors; clomipramine and anti-psychotics.

Major Depressive Disorder (MDD)

MDD is associated with substantial psychosocial dysfunction and high individual mental strain as well as with excess morbidity and mortality (the risk of suicide is considerable). The term major depressive disorder encompasses clinical depression, major depression, unipolar depression, unipolar disorder, recurrent depression and simply depression. The term major depressive disorder covers mood disorders; dysthymia; chronic depression; seasonal affective disorder and borderline personality disorder.

According to the DMS-5 criteria, MDD symptoms include a depressed mood, or loss of interest or pleasure in daily activities for more than two weeks; and impaired social, occupational and educational function. Specific symptoms, at least five of the following nine, present nearly every day: depressed mood or irritable most of the day; decreased interest or pleasure in most activities, most of each day; significant weight change or change in appetite; change in sleep (insomnia or hypersomnia); change in activity (psychomotor agitation or retardation); fatigue or loss of energy; guilt or worthlessness (feelings of worthlessness or excessive or inappropriate guilt); reduced concentration (diminished ability to think or concentrate, or more indecisiveness; and suicidality (thoughts of death or suicide, or subject has a suicide plan). In addition, MDD is associated with anxiety symptoms including irrational worry; preoccupation with unpleasant worries; trouble relaxing and/or feeling tense. MDD episodes can be mild, moderate or severe.

MDD episodes are often associated with comorbidity with other psychiatric disorders or with somatic disorders like Parkinson's disease, Alzheimer's disease, cerebrovascular disorders, cancer and chronic pain syndromes. MDD is frequently associated with a wide spectrum of other mental disorders as comorbidities including generalised anxiety disorder; anxiety disorder; substance use disorders; post-traumatic stress disorder (PTSD); personality disorders; pain; stress; irritable bowel syndrome; insomnia; headaches and interpersonal problems.

Major depressive disorder is a psychiatric disorder that may develop or persist due to dysfunction of the microbiota-gut-brain axis. Accordingly, in preferred embodiments, the compositions of the invention are for use in treating or preventing MDD in a subject.

In certain embodiments, the compositions of the invention are for use in treating or preventing acute major depressive episodes and/or the prevention of new episodes (recurrence prevention). In certain embodiments, the compositions of the invention prevent, reduce or alleviate the occurrence of mild, moderate or severe MDD episodes.

In certain embodiments, the compositions of the invention prevent, reduce or alleviate one or more of the symptoms of MDD as classified by the DMS-5 criteria listed herein. In a preferred embodiment, the compositions of the invention prevent, reduce or alleviate a depressed mood in a subject. In a preferred embodiment, the compositions of the invention prevent, reduce or alleviate a decreased interest or pleasure in most activities in a subject. In some embodiments, the compositions of the invention reduce the occurrence of symptoms of MDD within a 2-week period.

In some embodiments, the compositions of the invention improve the symptoms of MDD according to a symptomatic or diagnostic scale. Such scales for assessing symptomatic improvement include the Hamilton Rating Scale of Depression (HAMD) and the Montgomery Asberg Depression Rating Scale. In addition, the Zung Self-Rating Depression Scale (SDS) and Zung Self-Rating Anxiety Scale (SAS) are also suitable symptomatic improvement scales.

In some embodiments, the compositions of the invention improve the Clinical Global Impression—Global Improvement (CGI-I) scale for assessing psychiatric and neurological disorders. In some embodiments, the compositions of the invention display a positive effect on global social and occupational functioning of the subject with MDD.

In certain embodiments, the compositions of the invention are for use in treating or preventing treatment resistant MDD.

In preferred embodiments, the compositions of the invention prevent, reduce or alleviate at least one comorbidity of MDD. The comorbidities of MDD include generalised anxiety disorder; anxiety disorder; substance use disorders; post-traumatic stress disorder (PTSD); personality disorders; pain;

stress; IBS; insomnia; headaches and interpersonal problems.

In some embodiments, the compositions of the invention are particularly effective at preventing, reducing or alleviating MDD when used in combination with another therapy for treating MDD. Such therapies include antidepressants, augmentation strategies (e.g. combination therapy, lithium and other mood stabilizers, thyroid hormones and atypical antipsychotics) or even second generation antipsychotics.

Anxiety Disorders

Anxiety disorders are a group of mental disorders characterised by feelings of anxiety and fear. There are a number of anxiety disorders including generalised anxiety disorder (GAD); specific phobia; social anxiety disorder; separation anxiety disorder; agoraphobia; panic disorder and selective mutism.

GAD is diagnosed according to DMS-5 in six criterion. The first criterion is too much anxiety or worry over more than six months wherein the anxiety or worry is present most of the time in regards to many activities. The second criterion is that the subject is unable to manage the symptoms of the first criterion. The third criterion is that at least three (one in children) of the following occurs: restlessness; tires easily; problems concentrating; irritability; muscle tension and problems with sleep. The final three criterion are that the symptoms results in significant social, occupational and functional impairment; the symptoms are not due to medications, drugs, or other physical health problems; and the symptoms do not fit better with another psychiatric problem such as panic disorder. All other anxiety disorders may be considered as differential diagnoses of GAD.

GAD is frequently associated with a wide spectrum of other mental disorders as comorbidities including depression; substance use disorders; stress; IBS; insomnia; headaches; pain; cardiac events; interpersonal problems and AMID.

Anxiety disorders are psychiatric disorders that may develop or persist due to dysfunction of the microbiota-gut-brain axis. Accordingly, in preferred embodiments, the compositions of the invention are for use in treating or preventing anxiety disorders in a subject. In certain embodiments, the anxiety disorder is generalised anxiety disorder (GAD); specific phobia; social anxiety disorder; separation anxiety disorder; agoraphobia; panic disorder and selective mutism.

In certain embodiments, the compositions of the invention prevent, reduce or alleviate one or more of the symptoms of GAD in a subject as classified by the DMS-5 criteria listed herein. According to DMS-5, the same symptoms are associated with other anxiety disorders. Therefore, in certain embodiments, the compositions of the invention prevent, reduce or alleviate one or more of the symptoms of anxiety disorders in a subject. In preferred embodiments, the compositions of the invention prevent, reduce or alleviate the anxiety or worry of the subject. In certain embodiments, the compositions of the invention reduce the occurrence of symptoms within a six month period. In certain embodiments, the composition of the invention prevents, reduces or alleviates restlessness; fatigue;

loss of concentration; irritability; muscle tension; and/or problems with sleep. In some embodiments, the compositions of the invention prevent, reduce or alleviate social, occupational and functional impairment associated with anxiety disorders.

In some embodiments, the compositions of the invention improve the symptoms of anxiety disorders according to a symptomatic or diagnostic scale. In certain embodiments, the scale for assessing symptomatic improvement includes the Hamilton Anxiety Rating Scale (HAM-A). In some embodiments, the HAM-A total scale is used to assess primary endpoint. In other embodiments, the HAM-A psychic anxiety factor may be useful as a secondary endpoint.

In some embodiments, the compositions of the invention improve the Clinical Global Impression—Global Improvement (CGI-I) scale for assessing psychiatric and neurological disorders. In some embodiments, the compositions of the invention display a positive effect on global social, occupational and functional impairment of the subject with anxiety disorder. In some embodiments, the global scale is the Sheehan disability scale.

In preferred embodiments, the compositions of the invention prevent, reduce or alleviate at least one comorbidity of GAD and anxiety disorders. The comorbidities of GAD include depression; substance use disorders; stress; IBS; insomnia; headaches; pain; cardiac events; interpersonal problems and ADHD.

In some embodiments, the compositions of the invention are particularly effective at preventing, reducing or alleviating anxiety disorders when used in combination with another therapy for treating anxiety disorders. Such therapies include selective serotonin reuptake inhibitors (venlafaxine, duloxetine, escitalopram and paroxetine); benzodiazepines (alprazolam, lorazepam and clonazepam); pregabalin (Lyrica®) and gabapentin (Neurontin®); serotonin receptor partial agonists (buspirone and tandospirone); atypical serotonergic antidepressants (such as imipramine and clomipramine); monoamine oxidase inhibitors (MAOIs) (such as moclobemide and phenelzine); hydroxyzine; propranolol; clonidine; guanfacine and prazosin.

Post-Traumatic Stress Disorder (PTSD)

PTSD is a severe and disabling disorder, an essential feature of which is the inclusion of a traumatic event as a precipitating factor of this disorder.

The symptoms of PTSD are grouped into four main clusters according to the DMS-V criteria: (i) intrusion: examples include nightmares, unwanted thoughts of the traumatic events, flashbacks, and reacting to traumatic reminders with emotional distress or physiological reactivity; (ii) avoidance: examples include avoiding triggers for traumatic memories including places, conversations, or other reminders; (iii) negative alterations in cognitions and mood: examples include distorted blame of self or others for the traumatic event, negative beliefs about oneself or the world, persistent negative emotions (e.g., fear, guilt, shame), feeling alienated, and constricted affect (e.g., inability to experience positive emotions); (iv) alterations in arousal and reactivity: examples include angry, reckless, or self-destructive behaviour, sleep problems, concentration problems, increased startle response, and hypervigilance.

Symptoms that resolve within 4 weeks of the traumatic event meet the criteria for an Acute Stress Disorder. The DSM distinguishes between acute (duration of symptoms for less than three months) and chronic PTSD (duration of symptoms longer than 3 months). If the symptoms begin more than 6 months after the stressor, the disorder is defined as delayed onset PTSD.

PTSD carries high comorbidities with major depressive disorder and substance use disorders.

PTSD is a psychiatric disorder that may develop or persist due to dysfunction of the microbiota-gut-brain axis. Accordingly, in preferred embodiments, the compositions of the invention are for use in treating or preventing PTSD in a subject. According to a similar pathogenesis, in certain embodiments, the compositions of the invention are for use in treating or preventing stress disorders. In certain embodiments, the compositions of the invention treat acute stress disorder. In some embodiments, the compositions of the invention treat acute and/or chronic PTSD. In some embodiments, the compositions of the invention treat delayed onset PTSD.

In certain embodiments, the compositions of the invention prevent, reduce or alleviate one or more of the symptoms of PTSD (or stress disorder) in a subject as classified by the DMS-5 criteria listed herein. In preferred embodiments, the compositions of the invention prevent, reduce or alleviate intrusive thoughts in a subject with PTSD. In preferred embodiments, the compositions of the invention prevent, reduce or alleviate avoidance behaviour in a subject with PTSD. In preferred embodiments, the compositions of the invention prevent, reduce or alleviate negative alterations in cognitions and mood in a subject with PTSD. In preferred embodiments, the compositions of the invention prevent alterations in arousal and reactivity in a subject with PTSD.

In some embodiments, the compositions of the invention improve the symptoms of PTSD and stress disorders according to a symptomatic or diagnostic scale. In certain embodiments, the scale for assessing symptomatic improvement is the Clinical-Administered PTSD (CAPS) scale.

In some embodiments, the compositions of the invention improve the Clinical Global Impression-Global Improvement (CGI-I) scale for assessing psychiatric and neurological disorders. In some embodiments, the compositions of the invention display a positive effect on global social, occupational and functional impairment of the subject with PTSD and stress disorders. In some embodiments, the global scale is the Sheehan disability scale.

In preferred embodiments, the compositions of the invention prevent, reduce or alleviate at least one comorbidity of PTSD and stress disorders. The comorbidities of PTSD and stress disorders include MDD, substance use disorders; stress and anxiety.

In some embodiments, the compositions of the invention are particularly effective at preventing, reducing or alleviating PTSD and stress disorders when used in combination with another therapy for treating PTSD and stress disorders. Such therapies include serotoninergic agents, tricyclic antidepressants, mood stabilisers, adrenergic inhibiting agents, antipsychotics, benzodiazepines, sertraline (Zoloft®), fluoxetine (Prozac®) and/or paroxetine (Paxil®).

Schizophrenia Spectrum and Psychotic Disorders

These diseases affect a subject's ability to think clearly, make good judgements, respond emotionally, communicate effectively, understand reality, and behave appropriately. Psychotic diseases include schizophrenia (symptoms listed below); schizoaffective disorder (the subject has symptoms of both schizophrenia and a mood disorder, such as depression or bipolar disorder); schizophreniform disorder (displays the symptoms of schizophrenia, but the symptoms last for a shorter time: between 1 and 6 months); brief psychotic disorder (subjects display a sudden, short period of psychotic behaviour, often in response to a very stressful event, such as a death in the family—recovery is usually less than a month); delusional disorder (delusions last for at least 1 month); shared psychotic disorder; substance-induced psychotic disorder; psychotic disorder due to another medical condition; paraphrenia (displaying symptoms similar to schizophrenia and starting late in life, when people are elderly). The most well-known psychotic disorder is schizophrenia and the majority of psychotic disorders display similar symptoms to schizophrenia.

Schizophrenia is a severe psychiatric disease with a heterogeneous course and symptom profile. Schizophrenia presents clinically with so-called positive and negative symptoms. The positive symptoms include delusions, hallucinations, disorganised speech, and disorganised or catatonic behaviours. Negative symptoms include affective flattening, restriction in the fluency and productivity of thought and speech and in the initiation of goal directed behaviour. The positive symptoms appear to reflect an excess or distortion of normal functions, whereas negative symptoms appear to reflect a diminution or loss of normal function. In addition, cognitive deficits (defects of working memory, information processing, attention/vigilance, learning, reasoning and social cognition) are common. Cognitive deficits generally show poor improvement with current antipsychotic treatment. Schizophrenic patients also suffer from mood symptoms. Besides these predominant symptoms, schizophrenia is associated with a comorbidity with other psychiatric symptoms such as manic and depressive symptoms, anxiety or obsessive-compulsive symptoms, substance abuse and dependence, and personality disorder.

According to the DMS-5, for the diagnosis of schizophrenia, a subject must have at least two of the following symptoms: delusions; hallucinations; disorganised speech; disorganised or catatonic behaviour and negative symptoms. At least one of the symptoms must be the presence of delusions, hallucinations or disorganised speech. Continuous signs of disturbance must persist for at least 6 months, during which the subject must experience at least 1 month of active symptoms, with social or occupational deterioration problems occurring over a significant amount of time.

Schizophrenia spectrum and psychotic disorders are psychiatric disorders that may develop or persist due to dysfunction of the microbiota-gut-brain axis. Therefore, in preferred embodiments, the compositions of the invention are for use in treating or preventing schizophrenia spectrum and/or psychotic disorders in a subject. In certain embodiments, the schizophrenia spectrum and psychotic disorder is selected from schizophrenia; schizoaffective disorder; schizophreniform disorder; brief psychotic disorder; delusional disorder; shared psychotic disorder; substance-induced psychotic disorder; psychotic disorder due to another medical condition and paraphrenia. In preferred embodiments, the compositions of the invention are for use in treating or preventing schizophrenia. In certain embodiments, the schizophrenia is selected from paranoid, disorganised, catatonic, undifferentiated and residual schizophrenia.

In certain embodiments, the compositions of the invention prevent, reduce or alleviate one or more of the symptoms of schizophrenia in a subject as classified by the DMS-5 criteria listed herein. These embodiments apply to the prevention, reduction or alleviation of symptoms of other schizophrenia spectrum and psychotic disorders. In certain embodiments, the compositions of the invention prevent, reduce or alleviate negative symptoms of schizophrenia. In certain embodiments, the compositions of the invention prevent, reduce or alleviate positive symptoms of schizophrenia. In certain embodiments, the compositions of the invention prevent, reduce or alleviate negative and positive symptoms of schizophrenia. In preferred embodiments, the compositions of the invention prevent, reduce or alleviate delusions, hallucinations, disorganised speech, and disorganised or catatonic behaviours in a subject with schizophrenia. In preferred embodiments, the compositions of the invention prevent, reduce or alleviate affective flattening, restriction in the fluency and productivity of thought and speech and in the initiation of goal directed behaviour in a subject with schizophrenia. In preferred embodiments, the compositions of the invention prevent, reduce or alleviate the cognitive defects and/or mood disorders in a subject with schizophrenia.

In certain embodiments, the compositions of the invention reduce the occurrence of positive and/or negative symptoms of schizophrenia in a subject within a 6 month period. In certain embodiments, the compositions of the invention improve social and/or occupational functionality in a subject with schizophrenia spectrum or psychotic disorder.

In some embodiments, the compositions of the invention improve the symptoms of schizophrenia spectrum or psychotic disorders according to a symptomatic or diagnostic scale. In certain embodiments, the scale for assessing symptomatic improvement is the Positive and Negative Symptom Scale (PANSS) and Brief Psychiatric Rating Scale (BPRS). In certain embodiments, the Scale for Assessment of Negative Symptoms (SANS) is used.

In some embodiments, the compositions of the invention improve the Clinical Global Impression—Global Improvement (CGI-I) scale for assessing psychiatric and neurological disorders. In some embodiments, the compositions of the invention display a positive effect on global social and occupational impairment of the subject with schizophrenia spectrum or psychotic disorders.

In preferred embodiments, the compositions of the invention prevent, reduce or alleviate at least one comorbidity of schizophrenia spectrum or psychotic disorder. In certain embodiments, the comorbidity is as manic and depressive symptoms, anxiety or obsessive-compulsive symptoms, substance abuse and dependence, and personality disorder.

In certain embodiments, the compositions of the invention are for use in treating or preventing treatment resistant of refractory schizophrenia.

In some embodiments, the compositions of the invention are particularly effective at preventing, reducing or alleviating schizophrenia spectrum or psychotic disorders when used in combination with another therapy for treating PTSD and stress disorders. In certain embodiments, such therapies include first generation antipsychotics including chlorpromazine, fluphenazine, haloperidol and/or perphenazine. In certain embodiments, such therapies include second generation therapies including aripiprazole (Abilify®); asenapine (Saphris®); brexpiprazole (Rexulti®); cariprazine (Vraylar®); clozapine (Clozaril®); iloperidone (Fanapt®); lurasidone (Latuda®); olanzapine (Zyprexa®); paliperidone (Invega); quetiapine (Seroquel®); risperidone (Risperdal®); ziprasidone (Geodon®).

Bipolar Disorder

Bipolar disorder in general is a chronic disease. Mania is the cardinal symptom of bipolar disorder.

There are several types of bipolar disorder based upon the specific duration and pattern of manic and depressive episodes. In DMS-5, a distinction is made between bipolar I disorder, bipolar II disorder, cyclothymic disorder, rapid-cycling bipolar disorder and bipolar disorder NOS.

According to the DSM, mania is a distinct period of abnormally and persistently elevated, expansive, or irritable mood. The episode must last a week, and the mood must have at least three of the following symptoms: high self-esteem; reduced need for sleep; increase rate of speech; rapid jumping of ideas; easily distracted; an increased interest in goals or activities; psychomotor agitation; increased pursuit of activities with a high risk of danger.

Bipolar I disorder involves one or more manic or mixed (mania and depression) episodes and at least one major depressive episode (see above for symptoms of MDD episodes). Bipolar II disorder has one or more major depressive episodes accompanied by at least one hypomanic episode. There are no manic or mixed episodes. Hypomania is a lesser form of mania. The symptoms are responsible for significant social, occupational and functional impairments. Cyclothymia is characterized by changing low-level depression along with periods of hypomania. The symptoms must be present for at least two years in adults or one year in children before a diagnosis can be made. Symptom free periods in adults and children last no longer than two months or one month, respectively. Rapid cycling bipolar disorder is a severe form of bipolar disorder. It occurs when a person has at least four episodes of major depression, mania, hypomania, or mixed states within a year. Not-otherwise specified (NOS) bipolar disorder classified bipolar symptoms that do not clearly fit into other types. NOS is diagnosed when multiple bipolar symptoms are present but not enough to meet the label for any of the other subtypes.

Bipolar disorder is associated with the following comorbidities: ADHD; anxiety disorders; substance disorders; obesity and metabolic syndrome.

Bipolar disorder is a psychiatric disorder that may develop or persist due to dysfunction of the microbiota-gut-brain axis. Therefore, in preferred embodiments, the compositions of the invention are for use in treating or preventing bipolar disorder in a subject. In certain embodiments, the bipolar disorder is bipolar I disorder. In certain embodiments, the bipolar disorder is bipolar II disorder. In certain embodiments, the bipolar disorder is cyclothymic disorder. In certain embodiments, the bipolar disorder is rapid-cycling bipolar disorder. In certain embodiments, the bipolar disorder is bipolar disorder NOS.

In preferred embodiments, the compositions of the invention prevent, reduce or alleviate one or more of the symptoms of bipolar disorder in a subject. In certain embodiments, the compositions of the invention prevent, reduce or alleviate the occurrence of manic episodes in a subject. In certain embodiments, the compositions of the invention prevent, reduce or alleviate the occurrence of an abnormally and persistently elevated, expansive, or irritable mood. In certain embodiments, the compositions of the invention prevent, reduce or alleviate one or more of the following symptoms: high self-esteem; reduced need for sleep; increase rate of speech; rapid jumping of ideas; easily distracted; an increased interest in goals or activities; psychomotor agitation; increased pursuit of activities with a high risk of danger. In certain embodiments, the compositions of the invention prevent, reduce or alleviate the occurrence of one or more manic or mixed episodes in a subject. In certain embodiments, the compositions of the invention reduce the occurrence of at least one major depressive episode in a subject. In certain embodiments, the compositions of the invention prevent, reduce or alleviate the occurrence of at least one major depressive episode accompanied by at least one hypomanic episode.

In preferred embodiments, the compositions of the invention treat the acute phase of bipolar disorder and/or prevent the occurrence of further episodes. In certain embodiments, the compositions of the invention treat the acute phase of manic/depressive episodes in a subject with bipolar disorder and prevent occurrence of further manic/depressive episodes.

In some embodiments, the compositions of the invention improve the symptoms of bipolar disorder according to a symptomatic or diagnostic scale. In certain embodiments, the scale for assessing symptomatic improvement of manic episodes is the Manic State Rating Scale and the Young Mania Rating Scale. In certain embodiments, the scale is the Bech-Rafaelsen Mania Scale (BRMAS). In certain embodiments, scales for assessing symptomatic improvement of the switch from manic to depressive episodes include the Hamilton Depression Rating Scale, the Montgomery-Asberg Rating Scale, and the Bech-Rafaelsen Depression Scale.

In some embodiments, the compositions of the invention improve the Clinical Global Impression—Global Improvement (CGI-I) scale for assessing psychiatric and neurological disorders. In some embodiments, the compositions of the invention display a positive effect on global social, occupational and functional impairments of the subject with bipolar disorder.

In preferred embodiments, the compositions of the invention prevent, reduce or alleviate at least one comorbidity of bipolar disorder. In certain embodiments, the comorbidity is selected from ADHD, anxiety disorders, substance disorder, obesity and metabolic syndrome.

In certain embodiments, the compositions of the invention are for use in treating or preventing manic-depressive illness and bipolar disorder unresponsive to lithium and divalproex.

In some embodiments, the compositions of the invention are particularly effective at preventing, reducing or alleviating bipolar disorder when used in combination with another therapy for treating bipolar disorder. In certain embodiments, such therapies include lithium carbonate, anticonvulsant drugs (including valproate, divalproex, carbamazepine and lamotrigine) and antipsychotic drugs (including aripiprazole, olanzapine, quetiapine and risperidone).

Neurocognitive Disorders and Alzheimer's Disease

In DSM-5, the term dementia was replaced with the terms major neurocognitive disorder and mild neurocognitive disorder. Neurocognitive disorder is a heterogeneous class of psychiatric diseases. The most common neurocognitive disorder is Alzheimer's disease, followed by vascular dementias or mixed forms of the two. Other forms of neurodegenerative disorders (e.g. Lewy body disease, frontotemporal dementia, Parkinson's dementia, Creutzfeldt-Jakob disease, Huntington's disease, and Wernicke-Korsakoff syndrome) are accompanied by dementia.

The symptomatic criteria for dementia under DSM-5 are evidence of significant cognitive decline from a previous level of performance in one or more cognitive domains selected from: learning and memory; language; executive function; complex attention; perceptual-motor and social cognition. The cognitive deficits must interfere with independence in everyday activities. In addition, the cognitive deficits do not occur exclusively in the context of a delirium and are not better explained by another mental disorder (for example MDD or schizophrenia).

In addition to the primary symptom, subjects with neurocognitive disorders display behavioural and psychiatric symptoms including agitation, aggression, depression, anxiety, apathy, psychosis and sleep-wake cycle disturbances.

Neurocognitive disorders are psychiatric disorders that may develop or persist due to dysfunction of the microbiota-gut-brain axis. Therefore, in preferred embodiments, the compositions of the invention are for use in treating or preventing neurocognitive disorders in a subject. In preferred embodiments, the neurocognitive disorder is Alzheimer's disease. In other embodiments, the neurocognitive disorder is selected from vascular dementias; mixed form Alzheimer's disease and vascular dementia; Lewy body disease; frontotemporal dementia; Parkinson's dementia; Creutzfeldt-Jakob disease; Huntington's disease; and Wernicke-Korsakoff syndrome.

In preferred embodiments, the compositions of the invention prevent, reduce or alleviate one or more of the symptoms of neurocognitive disorders in a subject. In certain embodiments, the compositions of the invention prevent, reduce or alleviate the occurrence of cognitive decline in a subject. In certain embodiments, the compositions of the invention improve the level of performance of a subject with neurocognitive disorders in one or more cognitive domains selected from: learning and memory; language; executive function; complex attention; perceptual-motor and social cognition. In some embodiments, the compositions of the invention prevent, reduce or alleviate the occurrence of one or more behavioural and psychiatric symptoms associated with neurocognitive disorders selected from agitation, aggression, depression, anxiety, apathy, psychosis and sleep-wake cycle disturbances.

In certain embodiments, the compositions of the invention prevent, reduce or alleviate symptomatic disease by intervention in suspected pathogenic mechanisms at a preclinical stage. In certain embodiments, the compositions of the invention improve disease modification, with slowing or arrest of symptom progression. In some embodiments, the slowing or arrest of symptom progression correlates with evidence in delaying the underlying neuropathological process. In preferred embodiments, the compositions of the invention improve symptoms of neurocognitive disorders comprising enhanced cognitive and functional improvement. In preferred embodiments, the compositions of the invention improve the behavioural and psychiatric symptoms of dementia (BPSD). In preferred embodiments, the compositions of the invention improve the ability of a subject with neurocognitive disorder to undertake everyday activities.

In preferred embodiments, the compositions of the invention improve both cognition and functioning in a subject with Alzheimer's disease. In some embodiments, the composition of the invention improve the cognitive endpoint in a subject with Alzheimer's disease. In some embodiments, the compositions of the invention improve the functional endpoint in a subject with Alzheimer's disease. In preferred embodiments, the compositions of the invention improve the cognitive and functional endpoint in a subject with Alzheimer's disease. In yet further preferred embodiments, the compositions of the invention improve the overall clinical response (the global endpoint) in a subject with Alzheimer's disease.

In some embodiments, the compositions of the invention improve the symptoms of neurocognitive disorders according to a symptomatic or diagnostic test. In certain embodiments, the tests for assessing symptomatic improvement of Alzheimer's disease (and other neurocognitive disorders) are selected from objective cognitive, activities of daily living, global assessment of change, health related quality of life tests and tests assessing behavioural and psychiatric symptoms of neurocognitive disorders.

In certain embodiments, the objective cognitive tests for assessment of symptomatic improvement use the Alzheimer's disease Assessment Scale cognitive subscale (ADAS-cog) and the classic ADAS scale. In certain embodiments, symptomatic improvement of cognition is assessed using the Neurophysiological Test Battery for Use in Alzheimer's Disease (NTB).

In some embodiments, the global assessment of change test uses the Clinical Global Impression—Global Improvement (CGI-I) scale for assessing psychiatric and neurological disorders. In some embodiments, the global scale is the Clinician's Interview Based Impression of Change plus (CIBIC-plus). In some embodiments, the global scale is the Alzheimer's Disease Cooperative Study Unit Clinician's Global Impression of Change (ADCS-CGIC).

In certain embodiments, the health related quality of life measures are the Alzheimer's Disease-Related QOL (ADRQL) and the QOL-Alzheimer's Disease (QOL-AD).

In certain embodiments, the tests assessing behavioural and psychiatric symptoms of neurocognitive disorders are selected from the Behavioural pathology in Alzheimer's Disease Rating Scale (BEHAVE-AD); the Behavioural Rating Scale for Dementia (BRSD); the Neuropsychiatric Inventory (NPI); and the Cohen-Mansfield Agitation Inventory (CMAI).

In some embodiments, the compositions of the invention are particularly effective at preventing, reducing or alleviating neurocognitive disorders when used in combination with another therapy for treating neurocognitive disorders. In certain embodiments, such therapies include acetylcholinesterase inhibitors including donepezil (Aricept®), galantamine (Razadyne®) and rivastigmine (Exelon®), and memantine.

Parkinson's Disease

Parkinson's disease is a common neurodegenerative disease neuropathologically characterised by degeneration of heterogeneous populations of neural cells (dopamine-producing cells). The clinical diagnosis of Parkinson's disease requires bradykinesia and at least one of the following core symptoms: resting tremor; muscle rigidity and postural reflex impairment. Other signs and symptoms that may be present or develop during the progression of the disease are autonomic disturbances (sialorrhoea, seborrhoea, constipation, micturition disturbances, sexual functioning, orthostatic hypotension, hyperhydrosis), sleep disturbances and disturbances in the sense of smell or sense of temperature. Depressive symptoms and cognitive dysfunction comorbidities develop in many Parkinson's disease patients, as well as neurocognitive disorders related to Lewy Bodies.

Parkinson's disease is a psychiatric disorder that may develop or persist due to dysfunction of the microbiota-gut-brain axis. Therefore, in preferred embodiments, the compositions of the invention are for use in treating or preventing Parkinson's disease in a subject.

In preferred embodiments, the compositions of the invention prevent, reduce or alleviate one or more of the symptoms of Parkinson's disease in a subject. In preferred embodiments, the compositions of the invention prevent, reduce or alleviate one or more core symptoms of Parkinson's disease in a subject. In certain embodiments, the compositions of the invention prevent, reduce or alleviate bradykinesia in a subject. In certain embodiments, the compositions of the invention prevent, reduce or alleviate resting tremor; muscle rigidity and/or postural reflex impairment in a subject. In certain embodiments, the compositions of the invention prevent, reduce or alleviate one or more symptoms associated with Parkinson's disease progression selected from autonomic disturbances (sialorrhoea, seborrhoea, constipation, micturition disturbances, sexual functioning, orthostatic hypotension, hyperhydrosis), sleep disturbances and disturbances in the sense of smell or sense of temperature.

In preferred embodiments, the compositions of the invention prevent, reduce or alleviate depressive symptoms comorbid with Parkinson's disease. In certain embodiments, the compositions of the invention improve verbal memory and/or executive functions. In certain embodiments, the compositions of the invention improve attention, working memory, verbal fluency and/or anxiety.

In other preferred embodiments, the compositions of the invention prevent, reduce or alleviate cognitive dysfunctions comorbid with Parkinson's disease.

In certain embodiments, the compositions of the invention prevent, reduce or alleviate Parkinson's disease progression. In certain embodiments, the compositions of the invention prevent, reduce or alleviate later motor complications. In certain embodiments, the compositions of the invention prevent, reduce or alleviate late motor fluctuations. In certain embodiments, the compositions of the invention prevent, reduce or alleviate neuronal loss. In certain embodiments, the compositions of the invention improve symptoms of Parkinson's disease dementia (PDD). In certain embodiments, the compositions of the invention prevent, reduce or alleviate impairment of executive function, attention and/or working memory. In certain embodiments, the compositions of the invention improve dopaminergic neurotransmission. In certain embodiments, the compositions of the invention prevent, reduce or alleviate impaired dopaminergic neurotransmission.

In some embodiments, the compositions of the invention improve the symptoms of Parkinson's disease according to a symptomatic or diagnostic scale. In certain embodiments, the tests for assessing symptomatic improvement of motor function in Parkinson's disease is the Unified Parkinson's Disease Rating Scale. In particular, UPDRS II considers the activity of daily life and UPDRS III considers motor-examination.

In some embodiments, the compositions of the invention improve the symptoms associated the PDD according to a symptomatic or diagnostic test and/or scale. In certain embodiments, the test or scale is selected from the Hopkins Verbal Learning Test—Revised (HVLT-R); the Delis-Kaplan Executive Function System (D-KEFS) Color-Word Interference Test; the Hamilton Depression Rating Scale (HAM-D 17; depression); the Hamilton Anxiety Rating Scale (HAM-A; anxiety) and the Unified Parkinson's Disease Rating Scale (UPDRS; PD symptom severity).

In some embodiments, the compositions of the invention improve the Clinical Global Impression—Global Improvement (CGI-I) scale for assessing psychiatric and neurological disorders. In some embodiments, the compositions of the invention display a positive effect on global social and occupational impairment of the subject with Parkinson's disease.

In some embodiments, the compositions of the invention are particularly effective at preventing, reducing or alleviating neurocognitive disorders when used in combination with another therapy for treating neurocognitive disorders. In certain embodiments, such therapies include dopamine agonists (including L-Dopa+); monoamine oxidase inhibitors, catecholamine-O-methyl transferase inhibitors; anticholinergics and glutamate modulators.

Other Central Nervous System Disorders

In preferred embodiments, the compositions of the invention are for use in treating or preventing a central nervous system disorder associated with dysfunction of the microbiota-gut-brain axis. In addition to the embodiments above, the compositions of the invention are for use in treating or preventing psychosis; chronic fatigue syndrome (myalgic encephalomyelitis) and/or chronic pain. In further embodiments, the compositions of the invention may be useful for treating or preventing motor neuron disease; Huntington's disease; Guillain-Barre syndrome and/or meningitis.

Huntington's Disease

Huntington's disease is an inherited brain condition, caused by an inherited faulty gene, which damages certain nerve cells in the brain. This brain damage gets progressively worse over time and can affect movement, cognition (perception, awareness, thinking, judgement) and behaviour. Early features of the disease can include personality changes, mood swings, fidgety movements, irritability and altered behaviour.

In certain embodiments, the compositions of the invention are for use in treating or preventing Huntington's disease. In certain embodiments, the compositions of the invention manage the symptoms of Huntington's disease, such as irritability or excessive movement. In certain embodiments, the compositions of the invention treat the depression associated with Huntington's disease and/or improve symptoms such as social withdrawal, lack or interest and sleep disturbance. In certain embodiments, the compositions of the invention improve memory and ability to concentrate on tasks. In certain embodiments, the compositions of the invention treat disabling abnormal movements. In certain embodiments, the compositions of the invention treat behavioural problems, antisocial behaviour, irritability and psychosis associated with Huntington's disease. In certain embodiments, the compositions of the invention induce neuroprotection and prevent nerve damage. In certain embodiments, the compositions of the invention increase the levels of dopamine and/or the levels of dopamine-containing cells.

Neurochemical Factors, Neuropeptides and Neurotransmitters and the Microbiota-Gut-Brain Axis As outlined above, the microbiota-gut-brain axis is modulated by a number of different physiological systems. The microbiota-gut-brain axis is modulated by a number of signalling molecules. Alterations in the levels of these signalling molecules results in defects in central nervous system development and/or functionality. Indeed, many of the molecules disclosed in this section have been implicated in the functionality of the microbiota-gut-brain axis and the pathogenesis of central nervous system disorders or conditions ([14], [32], [10], [33]). The experiments performed by the inventors indicate that behavioural changes can be triggered by administration of *Blautia* strains. This effect may be mediated by an effect on levels of the signalling molecules, in particular those listed in this section. These alterations may be responsible for the therapeutic benefits associated with *Blautia* strains. Accordingly, due to the fact that the central nervous system disorders and conditions disclosed herein display a similar fundamental biochemical and physiological pathogenesis (i.e. via the microbiota-gut-brain axis), a similar therapeutic benefit of *Blautia* strains may be also achieved for these disorders and conditions. Administration of *Blautia stercoris* may be particularly effective for triggering behavioural changes associated with central nervous system disorders or conditions. In certain embodiments, administration of *Blautia wexlerae* may be particularly effective for triggering behavioural changes associated with central nervous system disorders or conditions.

The signalling of the microbiota-gut-brain axis is modulated by levels of neurochemical factors, neuropeptides and neurotransmitters. Accordingly, in certain embodiments, the compositions of the invention modulates levels of neurochemical factors, neuropeptides and neurotransmitters. Accordingly, in certain preferred embodiments, the compositions of the invention directly alter CNS biochemistry. In preferred embodiments, the compositions of the invention modulate the levels of brain-derived neurotrophic factor (BDNF). In certain embodiments, the compositions of the invention modulate the levels of monoamines. In certain embodiments, the monoamines are serotonin (5-hydroxytryptamine (5-HT)), dopamine, norepinephrine and/or epinephrine. In certain embodiments, the monoamines are catecholamines. In certain embodiments, the catecholamines are dopamine, norepinephrine and epinephrine. In certain embodiments, the monoamines are tryptamines. In certain embodiments, the tryptamines are serotonin and melatonin. In certain embodiments, the compositions of the invention modulate the levels of acetylcholine.

In certain preferred embodiments, the compositions of the invention modulate the levels of oxytoxin. Oxytocin is associated with emotional, social, cognitive and neuroendocrine physiologies as well as autoregulation. In particular, oxytocin release is involved in anxiolysis; positive mood; maternal behaviour, pair bonding; sexual behaviour; social memory; olfactory memory; anorexiant effects; attenuation of the HPA axis response to stress; autoexcitation during birth and suckling as well as other physiological and psychological processes. In certain embodiments, the compositions of the invention increase the levels of oxytocin. In certain embodiments, the compositions of the invention decrease the levels of oxytocin. In certain embodiments, the compositions of the invention increase or decrease oxytocin signalling. In certain embodiments, the compositions of the invention modulate the levels of oxytocin receptors. In certain embodiments, the compositions of the invention modulate the flux of calcium ions into or out of neuronal, muscle and gastrointestinal cells. In preferred embodiments, the compositions of the invention treat and prevent neurodevelopmental and neuropsychiatric disorders and diseases associated with the microbiota-gut-brain axis by modulating the levels of oxytocin.

In certain embodiments, the compositions of the invention modulate the levels of brain monoamines and metabolites thereof. In preferred embodiments, the monoamine is serotonin. In certain embodiments, the compositions of the invention modulate the serotonergic and/or kynurenine routes of tryptophan metabolism. In certain embodiments, the compositions of the invention modulate the levels of serotonin metabolites, such as 5-Hydroxyindoleacetic acid (5-HIAA). In certain embodiments, the compositions of the invention modulate the levels of dopamine metabolites, such as Homovanillic acid (HVA). Modulation of these neurotransmitters and neurochemical factors is useful for treating stress, depression and anxiety-related disorders.

The signalling of the microbiota-gut-brain axis is modulated by levels of γ-aminobutyric acid (GABA). Accordingly, in preferred embodiments, the compositions of the invention modulate the levels of GABA. GABA is an inhibitory neurotransmitter that reduces neuronal excitability. In certain embodiments, the compositions of the invention increase the levels of GABA. In certain embodiments, the compositions of the invention decrease the levels of GABA. In certain embodiments, the compositions of the invention alter GABAergic neurotransmission. In certain embodiments, the compositions of the invention modulate the level of GABA transcription in different regions of the central nervous system. In certain embodiments, the commensal derived GABA crosses the blood-brain barrier and affects neurotransmission directly. In certain embodiments, the compositions of the invention lead to a reduction of GABA in the hippocampus, amygdala and/or locus coeruleus. In certain embodiments, the compositions of the invention lead to an increase of GABA in cortical regions.

The levels of neuroactive molecules, such as serotonin, melatonin, GABA, histamines and acetylcholine are linked to the pathophysiology of central nervous system diseases such as dementia, Alzheimer's disease and Huntington's disease.

The signalling of the microbiota-gut-brain axis is modulated by levels of histamines. Accordingly, in certain embodiments, the compositions of the invention modulate the levels of histamines. In certain embodiments, the histamines has an immunoregulatory effect. In certain embodiments, histamine levels enable translocation of bacteria from the lumen into systemic circulation. Therefore, in some embodiments, the compositions of the invention alter gastrointestinal tract permeability and/or barrier function. In certain other embodiments, the histamine acts as a neurotransmitter linked to central processes.

The signalling of the microbiota-gut-brain axis is modulated by the HPA axis. Accordingly, in certain embodiments, the compositions of the invention modulate HPA activity. In certain embodiments, the compositions of the invention attenuate the HPA stress response. In certain preferred embodiments, the compositions of the invention modulate inflammatory responses associated with HPA activity. In certain embodiments, the compositions of the invention modulate the levels of glucocorticoids. In certain preferred embodiments, the compositions of the invention modulate the levels of corticosterone and adrenaline. In certain embodiments, the compositions of the invention modulate the levels of corticotrophin-releasing factor and/or vasopressin. In certain embodiments, the compositions of the invention modulate the levels of vasopressin and/or other neurohypophysial or antidiuretic hormones. Alterations in HPA axis activity are associated with anxiety and stress disorders.

The signalling of the microbiota-gut-brain axis is modulated by alterations in the immune response and inflammatory factors and markers. Accordingly, in certain embodiments, the compositions of the invention may modulate the immune response. In certain embodiments, the compositions of the invention modulate the systemic levels of circulating neuroimmune signalling molecules. In certain preferred embodiments, the compositions of the invention modulate pro-inflammatory cytokine production and inflammation. In certain embodiments, the compositions of the invention modulate the inflammatory state. In certain embodiments, the compositions of the invention modulate the splenocyte proliferative response. In certain embodiments, the compositions of the invention modulate the systemic and/or plasma levels of C-reactive protein; IL-1 family cytokines; IL-1β; IL-2; IL-4; IL-6; IL-8; IL-10; IL-12p40; IL-17; IL-17A; IL-21; IL-23; TNF-α and IFN-γ. In some embodiments the compositions of the invention module the levels of anti-inflammatory cytokines, for example IL-10. In preferred embodiments, the compositions of the invention increase the levels of IL-10. In some embodiments, the compositions of the invention modulate the levels of TNF-α. In preferred embodiments, the compositions of the invention modulate the levels of IFN-γ. In some embodiments, the compositions of the invention modulate the IFN-γ:IL-10 ratio. In certain preferred embodiments, the compositions of the invention decrease the IFN-γ:IL-10 ratio. In preferred embodiments, the compositions of the invention decrease the levels of the pro-inflammatory cytokines TNF-α and IFN-γ. Increased circulating levels of cytokines are closely associated with various neuropsychiatric disorders, including depression, anxiety, schizophrenia and ASD. Evidence of inflammatory state alteration is highlighted in disorders such as schizophrenia, major depressive disorder and bipolar disorder.

In certain embodiments, the compositions of the invention modulates the levels of tolerance-mediating dendritic cells and reciprocally regulate pro and anti-inflammatory cytokine responses. In certain embodiments, the compositions of the invention decrease the systemic level of myeloperoxidase (a marker for inflammation and oxidation). Therapeutic modulators of the immune system and of inflammatory responses are useful for treating autism spectrum disorders and mood disorders.

In certain embodiments, the compositions of the invention modulate the immune response to an infection or vaccination. In certain embodiments, the compositions of the invention modulate the level of inflammation in response to infection or vaccination. In certain preferred embodiments, the compositions of the invention modulate maternal immune activation in response to an infection or vaccination during pregnancy. Accordingly, the compositions of the invention can be administered during pregnancy in order to treat or prevent a central nervous system disorder in the offspring.

The signalling of the microbiota-gut-brain axis is modulated by levels commensal metabolites. Accordingly, in certain embodiments, the compositions of the invention modulate the systemic levels of microbiota metabolites. In certain preferred embodiments, the compositions of the invention modulate the level of short chain fatty acids (SCFAs). In certain embodiments the level of SCFAs is increased or decreased. In some embodiments, the SCFA is butyric acid (BA) (or butyrate). In some embodiments, the SCFA is propionic acid (PPA). In some embodiments, the SCFA is acetic acid. In certain embodiments, the compositions of the invention modulate the ability of SCFAs to cross the blood-brain barrier. In certain embodiments, the compositions of the invention modulate the level of Polysaccharide A (PSA). In certain embodiments, the compositions of the invention modulate the levels of the potent pro-inflammatory endotoxin lipopolysaccharide (LPS). LPS leads to the production of inflammatory cytokines that alter physiological brain activity and modulate neuropeptide synthesis. LPS has an important influence on the modulation of the CNS, increasing the activity of areas devoted to the control of emotions (e.g. the amygdala). In certain embodiments, the compositions of the invention modulate the level of tryptophan and/or its metabolites. In certain embodiments, the compositions of the invention modulate the levels of 4-ethylphenylsulphate (4EPS; a uremic toxic associated with ASD-related behavioural abnormalities). In preferred embodiments, the compositions of the invention decrease the levels of 4-ethylphenylsulphate in a subject. The signals generated by the stimulation of neuronal signalling pathways caused by intraluminal gut stimuli strongly modulate brain activity, including pain perception, immune-response modulation, emotional control and other homeostatic functions. Accordingly, a composition able to modulate levels of these factors would have broad therapeutic applications for treating or preventing CNS disorders.

The signalling of the microbiota-gut-brain axis is modulated by levels gastrointestinal permeability. Accordingly, in some embodiments, the compositions of the invention alter the integrity of the gastrointestinal tract epithelium. In certain embodiments, the compositions of the invention modulate the permeability of the gastrointestinal tract. In certain embodiments, the compositions of the invention modulate the barrier function and integrity of the gastrointestinal tract. In certain embodiments, the compositions of the invention modulate gastrointestinal tract motility. In certain embodiments, the compositions of the invention modulate the translocation of commensal metabolites and inflammatory signalling molecules into the bloodstream from the gastrointestinal tract lumen.

The signalling of the microbiota-gut-brain axis is modulated by microbiome composition in the gastrointestinal tract. Accordingly, in certain embodiments, the compositions of the invention modulates the microbiome composition of the gastrointestinal tract. In certain embodiments, the compositions of the invention prevents microbiome dysbiosis and associated increases in toxic metabolites (e.g. LPS). In certain embodiments, the compositions of the invention modulate the levels of *Clostridium* in the gastrointestinal tract. In preferred embodiments, the compositions of the invention reduce the level of *Clostridium* in the gastrointestinal tract. In certain embodiments, the compositions of the invention reduce the levels of *Campylobacter jejuni*. In certain embodiments, the compositions of the invention modulate the proliferation of harmful anaerobic bacteria and the production of neurotoxins produced by these bacteria. In certain embodiments, the compositions of the invention modulate the microbiome levels of *Lactobacillus* and/or *Bifidobacterium*. In certain embodiments, the compositions of the invention modulate the microbiome levels of *Sutterella, Prevotella, Ruminoccucs* genera and/or the Alcaligenaceae family. In certain embodiments, the compositions of the invention increase the level of *Lactobacillus plantarum* and/or *Saccharomyces boulardii*.

In certain embodiments, the compositions of the invention prevent the dysregulation of the composition of the microbiome by extensive antibiotic use. In certain preferred embodiments, the compositions of the invention maintain a functional maternal microbiome composition upon administration of antibiotics during pregnancy. Accordingly, the compositions of the invention can be administered during pregnancy in order to treat or prevent a central nervous system disorder in the offspring.

Modulation of the microbiome has been shown to be effective at improving psychiatric disorder-related behaviours, including anxiety, depression, autism spectrum disorder, obsessive-compulsive disorder and memory abilities (including spatial and non-spatial memory), as well as other CNS-related disorders including Parkinson's disease. Certain studies have suggested that probiotics can reduce psychological stress, somatisation, depression and anger-hostility. The levels of *Lactobacillus* are associated with depression and have been implicated in pain signalling associated with gastrointestinal discomfort.

In certain embodiments, the compositions of the invention prevent, reduce or alleviate at least one of the behavioural symptoms associated with a central nervous system disorder described herein. In preferred embodiments, the compositions of the invention improve the overall clinical response in a subject.

In preferred embodiments, the compositions of the invention prevent, reduce or alleviate stereotyped, repetitive behaviour in a subject. In preferred embodiments, the compositions of the invention prevent, reduce or alleviate the occurrence of unusually restrictive behaviours and/or interests. In certain embodiments, the compositions of the invention prevent, reduce or alleviate recurrent obsessions and/or compulsions in a subject. In preferred embodiments, the compositions of the invention prevent, reduce or alleviate deficits in social behaviour in a subject. In preferred embodiments, the compositions of the invention prevent, reduce or alleviate avoidance behaviour in a subject. In preferred embodiments, the compositions of the invention prevent, reduce or alleviate deficits in communication behaviour in a subject.

In preferred embodiments, the compositions of the invention prevent, reduce or alleviate negative alterations in cognitions and mood in a subject. In preferred embodiments, the compositions of the invention prevent, reduce or alleviate anxiety-related behaviour in a subject. In preferred embodiments, the compositions of the invention prevent, reduce or alleviate stress-related behaviour in a subject. In preferred embodiments, the compositions of the invention prevent, reduce or alleviate depression-related behaviour in a subject. In preferred embodiments, the compositions of the invention prevent, reduce or alleviate aggressive behaviour in a subject. In preferred embodiments, the compositions of the invention prevent, reduce or alleviate the occurrence of an abnormally and persistently elevated, expansive, or irritable mood.

In preferred embodiments, the compositions of the invention prevent, reduce or alleviate intrusive thoughts in a subject. In preferred embodiments, the compositions of the invention prevent alterations in arousal and reactivity in a subject. In preferred embodiments, the compositions of the invention prevent, reduce or alleviate delusions, hallucinations, disorganised speech, and disorganised or catatonic behaviours in a subject. In preferred embodiments, the compositions of the invention prevent, reduce or alleviate affective flattening, restriction in the fluency and productivity of thought and speech and in the initiation of goal directed behaviour in a subj ect. In preferred embodiments, the compositions of the invention prevent, reduce or alleviate one or more of the following symptoms: high self-esteem; reduced need for sleep; increase rate of speech; rapid jumping of ideas; easily distracted; an increased interest in goals or activities; psychomotor agitation; increased pursuit of activities with a high risk of danger.

In preferred embodiments, the compositions of the invention improve spatial and/or non-spatial memory deficits in a subject. In preferred embodiments, the compositions of the invention improve both cognition and functioning in a subject. In preferred embodiments, the compositions of the invention improve locomotor activity in a subject. In preferred embodiments, the compositions of the invention prevent, reduce or alleviate bradykinesia in a subject. In preferred embodiments, the compositions of the invention prevent, reduce or alleviate resting tremor; muscle rigidity and/or postural reflex impairment in a subject.

In preferred embodiments, the compositions of the invention prevent, reduce or alleviate at least one comorbidity associated with a CNS disorder disclosed herein.

In preferred embodiments, the compositions of the invention improve the scores of a subject on at least one of the symptomatic and/or diagnostic scales for CNS disorders described herein. In certain other embodiments, the symptomatic and/or diagnostic scale is selected from the General Health Questionnaire (GHQ); the Depression Anxiety and Stress Scale (DASS); the Leiden Index of Depression Sensitivity-Revised (LEIDS-r); the Positive and Negative Symptom Scale (PANSS); the State-Trait Anxiety Inventory (STAI); the Development Behavior Checklist (DBC); the Beck Depression Inventory (BDI); the Beck Anxiety Inventory (BAI); the Hopkins Symptom Checklist (HSCL-90); the Hospital Anxiety and Depression Scale (HADS); the Perceived Stress Scale (PSS); the Coping Checklist (CCL) (also used to counter the stress of daily life); and the questionnaire-based Profile of Mood State (POMS).

In certain embodiments, the compositions of the invention may improve the symptomatic and/or diagnostic scale when assessing therapeutic efficacy in other animal models of CNS disorders known to a person skilled in the art. In addition to the behavioural assays disclosed in the examples, the compositions of the invention may improve reciprocal social interactions; olfactory communication; ultrasonic vocalisation; motor stereotypes (such as circling and vertical jumping), repetitive behaviour such as self-grooming and diffing; and perseverance in spatial tasks.

In addition, the compositions of the invention will be useful in treating and/or preventing CNS disorders in other animal models of CNS disorders. Other mouse models include inbred mice strains (including BALB/cJ and C58/J) and also genetically modified mice strains (including NEUREXIN1, NEUROLIGIN3, NEUROLIGIN4, SHANK2, SHANK3, CNTNAP2, Tsc1/2 and Fmr1 gene mutant mice strains).

Butyrate is a short chain fatty acid that acts as a histone deacetylase inhibitor, is capable of signalling through G-protein coupled receptors and is implicated in the regulation of metabolic pathways.

The Examples demonstrate that *Blautia hydrogenotrophica* increases the intestinal levels of butyrate when administered in oral compositions. The Examples also demonstrate that *Blautia hydrogenotrophica* is useful for treating central nervous system disorders and conditions. This effect of *Blautia hydrogenotrophica* may be mediated by butyrate.

Butyrate has been linked to histone deacetylation in the hippocampus and frontal cortex of the brain [34] and has been implicated in Huntington's disease, Parkinson's disease, Alzheimer's disease and autism [35].

In certain embodiments, the *Blautia hydrogenotrophica* strain for use in the invention is a butyrate producer. In certain embodiments, the *Blautia hydrogenotrophica* strain for use in the invention synthesise butyrate by the acetyl-CoA, glutarate, 4-aminobutyrate and/or lysine pathways. In certain embodiments, the *Blautia hydrogenotrophica* strain for use in the invention metabolises complex polysaccharides (e.g. starch and xylan) to produce acetyl-CoA, which can subsequently be used to synthesise butyrate. In certain embodiments, the *Blautia hydrogenotrophica* strain for use in the invention produces butyrate by bacterial fermentation in the colon.

In certain preferred embodiments, the compositions of the invention comprising *Blautia hydrogenotrophica* modulate the levels of butyrate. In certain embodiments, compositions of the invention comprising *Blautia hydrogenotrophica* increase the levels of butyrate.

In certain embodiments, the composition of the invention comprising *Blautia hydrogenotrophica* is a histone deacetylase (HDAC) inhibitor. In certain embodiments, the composition of the invention comprising *Blautia hydrogenotrophica* inhibits histone deacetylation in the hippocampus and frontal cortex of the brain. In certain embodiments, the composition of the invention comprising *Blautia hydrogenotrophica* increases histone acetylation and promotes the expression of pro-survival, pro-regenerative and pro-plasticity genes. In certain embodiments, the composition of the invention comprising *Blautia hydrogenotrophica* rescues histone acetylation, prevents neuronal cell death and extends lifespan (for example in Huntington's disease). In certain embodiments, the composition of the invention comprising *Blautia hydrogenotrophica* protects neurones from cell death (for example in Parkinson's disease). In certain embodiments, the composition of the invention comprising *Blautia hydrogenotrophica* restores histone acetylation and increases the expression of learning associated genes (e.g. for treating or preventing Alzheimer's disease). In certain embodiments, these epigenetic modifications may be potential psychiatric treatments.

In certain embodiments, the HDAC inhibitor activity of the composition of the invention comprising *Blautia hydrogenotrophica* influences the transcription of numerous genes involved in neuronal survival, plasticity and regeneration. In certain embodiments, the composition of the invention comprising *Blautia hydrogenotrophica* increases the acetylation around the promoters of neurotrophic factors. In certain embodiments, the composition of the invention comprising *Blautia hydrogenotrophica* increases the acetylation around the promoter of BDNF, GDNF and NGF. In certain embodiments, the composition of the invention comprising *Blautia hydrogenotrophica* increases the expression of BDNF, GDNF and NGF. In certain embodiments, the composition of the invention comprising *Blautia hydrogenotrophica* increases the expression of immediate early genes involved in plasticity, including c-Fos and Homer1a. In certain embodiments, the expression of these factors is altered in the brain.

In certain embodiments, the deacetylase inhibitory activity of the composition of the invention comprising *Blautia hydrogenotrophica* maintains acetylation of non-histone proteins. In certain embodiments, the acetylation affects the enzymatic and metabolic activity of many proteins. For example, HDAC inhibitors have been shown to maintain acetylation and activation of the transcription factor Sp1 during oxidative stress, enhancing the protective adaptive response to promote cell survival. In certain embodiments, the composition of the invention comprising *Blautia hydrogenotrophica* prevents oxidative stress in vivo.

In certain embodiments, the composition of the invention comprising *Blautia hydrogenotrophica* restores blood-brain barrier (BBB) integrity and/or tight junction protein expression (e.g. claudin 5 and/or occluding) in the frontal cortex, hippocampus and striatum. In certain embodiments, the composition of the invention comprising *Blautia hydrogenotrophica* restores and/or maintains BBB integrity. In certain embodiments, the composition of the invention comprising *Blautia hydrogenotrophica* promotes and/or maintains tight junction expression. Therefore, in certain embodiments, the composition of the invention comprising *Blautia hydrogenotrophica* can establish and/or maintain a barrier to inflammatory mediators, neurochemical factors, neuropeptides and neurotransmitters associated with central nervous system disorders, in particular neurodevelopmental disorders and/or neuropsychiatric conditions.

In certain embodiments, the composition of the invention comprising *Blautia hydrogenotrophica* inhibits neuro-inflammation. In certain embodiments, the composition of the invention comprising *Blautia hydrogenotrophica* increases the levels of IL-1RA (an inhibitor of the pro-inflammatory IL-1β). In certain embodiments, the composition of the invention comprising *Blautia hydrogenotrophica* decreases the levels pro-inflammatory IL-1β and/or TNFα. In certain embodiments, the composition of the invention comprising *Blautia hydrogenotrophica* increases IL-4 expression, which increases the levels of IL-IRA.

In certain embodiments, the composition of the invention comprising *Blautia hydrogenotrophica* is an anti-inflammatory agent. In certain embodiments, the composition of the invention comprising *Blautia hydrogenotrophica* inhibits nuclear factor κB (NF-κB) activation. Accordingly, the composition of the invention comprising *Blautia hydrogenotrophica* may modulate the expression of early immune inflammatory response genes, including IL-1B, TNFα, IL-2, IL-6, IL-8, IL-12, inducible nitric acid synthase, cyclooxygenase-2, intercellular adhesion molecule-1, T cell receptor-α and MHC class II molecules.

In certain embodiments, the composition of the invention comprising *Blautia hydrogenotrophica* affects mitochondrial activity. Accordingly, in certain embodiments, the composition of the invention comprising *Blautia hydrogenotrophica* treats and/or prevents Alzheimer's disease, Parkinson's disease, Huntington's disease, mitochrondial encephalopathy and/or adrenoleukodystrophy.

In certain embodiments, the composition of the invention comprising *Blautia hydrogenotrophica* affects the signalling through GPCRs. Accordingly, in certain embodiments, the composition of the invention comprising *Blautia hydrogenotrophica* treats and/or prevents Parkinson's disease.

In certain embodiments, the composition of the invention comprising *Blautia hydrogenotrophica* affects histone acetylation. Accordingly, in certain embodiments, the composition of the invention comprising *Blautia hydrogenotrophica* treats and/or prevents Alzheimer's disease, Parkinson's disease, and/or Huntington's disease.

In certain embodiments, the composition of the invention comprising *Blautia hydrogenotrophica* affects microbiome homeostasis. Accordingly, in certain embodiments, the composition of the invention comprising *Blautia hydrogenotrophica* treats and/or prevents central nervous system disorders and conditions.

In certain embodiments, the compositions of the invention comprising *Blautia hydrogenotrophica* may trigger improvement in behavioural changes associated with central nervous system disorders or conditions.

In certain embodiments, the effects of *Blautia hydrogenotrophica* may be independent of butyrate. For example, the Examples demonstrate that administration of *Blautia hydrogenotrophica*, but not butyrate alone, significantly increases horizontal and vertical activity of mice and time spent in the centre of the open field model suggesting a role in reducing anxiety. Specifically, *Blautia hydrogenotrophica* displays efficacy in reducing anxiety-like and stereotyped behaviour, while the efficacy of butyrate is limited to reducing stereotyped behaviour.

Modes of Administration

Preferably, the compositions of the invention are to be administered to the gastrointestinal tract in order to enable delivery to and/or partial or total colonisation of the intestine with the bacterial strain of the invention. Generally, the compositions of the invention are administered orally, but they may be administered rectally, intranasally, or via buccal or sublingual routes.

In certain embodiments, the compositions of the invention may be administered as a foam, as a spray or a gel.

In certain embodiments, the compositions of the invention may be administered as a suppository, such as a rectal suppository, for example in the form of a theobroma oil (cocoa butter), synthetic hard fat (e.g. suppocire, witepsol), glycero-gelatin, polyethylene glycol, or soap glycerin composition.

In certain embodiments, the composition of the invention is administered to the gastrointestinal tract via a tube, such as a nasogastric tube, orogastric tube, gastric tube, jejunostomy tube (J tube), percutaneous endoscopic gastrostomy (PEG), or a port, such as a chest wall port that provides access to the stomach, jejunum and other suitable access ports.

The compositions of the invention may be administered once, or they may be administered sequentially as part of a treatment regimen. In certain embodiments, the compositions of the invention are to be administered daily.

In certain embodiments of the invention, treatment according to the invention is accompanied by assessment of the patient's gut microbiota. Treatment may be repeated if delivery of and/or partial or total colonisation with the strain of the invention is not achieved such that efficacy is not observed, or treatment may be ceased if delivery and/or partial or total colonisation is successful and efficacy is observed.

In certain embodiments, the composition of the invention may be administered to a pregnant animal, for example a mammal such as a human in order to prevent an inflammatory or autoimmune disease developing in her child in utero and/or after it is born.

The compositions of the invention may be administered to a patient that has been diagnosed with a central nervous system disorder or condition, in particular a central nervous system disorder or condition mediated by the microbiota-gut-brain axis, or that has been identified as being at risk of a central nervous system disorder or condition, in particular central nervous system disorder or condition mediated by the microbiota-gut-brain axis. The compositions may also be administered as a prophylactic measure to prevent the development of central nervous system disorders or conditions, in particular central nervous system disorders or conditions mediated by the microbiota-gut-brain axis in a healthy patient.

The compositions of the invention may be administered to a patient that has been identified as having an abnormal gut microbiota. For example, the patient may have reduced or absent colonisation by Blautia, in particular *Blautia stercoris* or *Blautia wexlerae*. For example, the patient may have reduced or absent colonisation by *Blautia*, in particular *Blautia stercoris, Blautia wexlerae* or *Blautia hydrogenotrophica*.

The compositions of the invention may be administered as a food product, such as a nutritional supplement.

Generally, the compositions of the invention are for the treatment of humans, although they may be used to treat animals including monogastric mammals such as poultry, pigs, cats, dogs, horses or rabbits. The compositions of the invention may be useful for enhancing the growth and performance of animals. If administered to animals, oral gavage may be used.

Compositions

Generally, the composition of the invention comprises bacteria. In preferred embodiments of the invention, the composition is formulated in freeze-dried form. For example, the composition of the invention may comprise granules or gelatin capsules, for example hard gelatin capsules, comprising a bacterial strain of the invention.

Preferably, the composition of the invention comprises lyophilised bacteria. Lyophilisation of bacteria is a well-established procedure and relevant guidance is available in, for example, references [36], [ ], and [38].

Alternatively, the composition of the invention may comprise a live, active bacterial culture.

In some embodiments, the bacterial strain in the composition of the invention has not been inactivated, for example, has not been heat-inactivated. In some embodiments, the bacterial strain in the composition of the invention has not been killed, for example, has not been heat-killed. In some embodiments, the bacterial strain in the composition of the invention has not been attenuated, for example, has not been heat-attenuated. For example, in some embodiments, the bacterial strain in the composition of the invention has not been killed, inactivated and/or attenuated. For example, in some embodiments, the bacterial strain in the composition of the invention is live. For example, in some embodiments, the bacterial strain in the composition of the invention is viable. For example, in some embodiments, the bacterial strain in the composition of the invention is capable of partially or totally colonising the intestine. For example, in some embodiments, the bacterial strain in the composition of the invention is viable and capable of partially or totally colonising the intestine.

In some embodiments, the composition comprises a mixture of live bacterial strains and bacterial strains that have been killed.

In preferred embodiments, the composition of the invention is encapsulated to enable delivery of the bacterial strain to the intestine. Encapsulation protects the composition from degradation until delivery at the target location through, for example, rupturing with chemical or physical stimuli such as pressure, enzymatic activity, or physical disintegration, which may be triggered by changes in pH. Any appropriate encapsulation method may be used. Exemplary encapsulation techniques include entrapment within a porous matrix, attachment or adsorption on solid carrier surfaces, self-aggregation by flocculation or with cross-linking agents, and mechanical containment behind a microporous membrane or a microcapsule. Guidance on encapsulation that may be useful for preparing compositions of the invention is available in, for example, references [39] and [40].

The composition may be administered orally and may be in the form of a tablet, capsule or powder. Encapsulated products are preferred because *Blautia* are anaerobes. Other ingredients (such as vitamin C, for example), may be included as oxygen scavengers and prebiotic substrates to improve the delivery and/or partial or total colonisation and survival in vivo. Alternatively, the probiotic composition of the invention may be administered orally as a food or nutritional product, such as milk or whey based fermented dairy product, or as a pharmaceutical product.

The composition may be formulated as a probiotic.

A composition of the invention includes a therapeutically effective amount of a bacterial strain of the invention. A therapeutically effective amount of a bacterial strain is sufficient to exert a beneficial effect upon a patient. A therapeutically effective amount of a bacterial strain may be sufficient to result in delivery to and/or partial or total colonisation of the patient's intestine.

A suitable daily dose of the bacteria, for example for an adult human, may be from about $1 \times 10^3$ to about $1 \times 10^{11}$ colony forming units (CFU); for example, from about $1 \times 10^7$ to about $1 \times 10^{10}$ CFU; in another example from about $1 \times 10^6$ to about $1 \times 10^{10}$ CFU.

In certain embodiments, the composition contains the bacterial strain in an amount of from about $1 \times 10^6$ to about $1 \times 10^{11}$ CFU/g, respect to the weight of the composition; for example, from about $1 \times 10^8$ to about $1 \times 10$ CFU/g. The dose may be, for example, 1 g, 3 g, 5 g, and 10 g.

Typically, a probiotic, such as the composition of the invention, is optionally combined with at least one suitable prebiotic compound. A prebiotic compound is usually a non-digestible carbohydrate such as an oligo- or polysaccharide, or a sugar alcohol, which is not degraded or absorbed in the upper digestive tract. Known prebiotics include commercial products such as inulin and transgalacto-oligosaccharides.

In certain embodiments, the probiotic composition of the present invention includes a prebiotic compound in an amount of from about 1 to about 30% by weight, respect to the total weight composition, (e.g. from 5 to 20% by weight). Carbohydrates may be selected from the group consisting of: fructo-oligosaccharides (or FOS), short-chain fructo-oligosaccharides, inulin, isomalt-oligosaccharides, pectins, xylo-oligosaccharides (or XOS), chitosan-oligosaccharides (or COS), beta-glucans, arable gum modified and resistant starches, polydextrose, D-tagatose, acacia fibers, carob, oats, and citrus fibers. In one aspect, the prebiotics are the short-chain fructo-oligosaccharides (for simplicity shown herein below as FOSs-c.c); said FOSs-c.c. are not digestible carbohydrates, generally obtained by the conversion of the beet sugar and including a saccharose molecule to which three glucose molecules are bonded.

In certain embodiments, the compositions of the invention are used in combination with another therapeutic compound for treating or preventing the central nervous system disorder. In some embodiments, the compositions of the invention are administered with nutritional supplements that modulate central neurotransmitters and neuropeptides. In preferred embodiments, the nutritional supplements comprise or consist of nutritional vitamins. In certain embodiments, the vitamins are vitamin B6, magnesium, dimethylglycine (vitamin B16) and vitamin C. In certain embodiments, the compositions of the invention are administered in combination with another probiotic. In certain preferred embodiments, the probiotic comprises or consists of Trichuris suis ova.

The compositions of the invention may comprise pharmaceutically acceptable excipients or carriers. Examples of such suitable excipients may be found in the reference [41]. Acceptable carriers or diluents for therapeutic use are well known in the pharmaceutical art and are described, for example, in reference [42]. Examples of suitable carriers include lactose, starch, glucose, methyl cellulose, magnesium stearate, mannitol, sorbitol and the like. Examples of suitable diluents include ethanol, glycerol and water. The choice of pharmaceutical carrier, excipient or diluent can be selected with regard to the intended route of administration and standard pharmaceutical practice. The pharmaceutical compositions may comprise as, or in addition to, the carrier, excipient or diluent any suitable binder(s), lubricant(s), suspending agent(s), coating agent(s), solubilising agent(s). Examples of suitable binders include starch, gelatin, natural sugars such as glucose, anhydrous lactose, free-flow lactose, beta-lactose, corn sweeteners, natural and synthetic gums, such as acacia, tragacanth or sodium alginate, carboxymethyl cellulose and polyethylene glycol. Examples of suitable lubricants include sodium oleate, sodium stearate, magnesium stearate, sodium benzoate, sodium acetate, sodium chloride and the like. Preservatives, stabilizers, dyes and even flavouring agents may be provided in the pharmaceutical composition. Examples of preservatives include sodium benzoate, sorbic acid and esters of p-hydroxybenzoic acid. Antioxidants and suspending agents may be also used.

The compositions of the invention may be formulated as a food product. For example, a food product may provide nutritional benefit in addition to the therapeutic effect of the invention, such as in a nutritional supplement. Similarly, a food product may be formulated to enhance the taste of the composition of the invention or to make the composition more attractive to consume by being more similar to a common food item, rather than to a pharmaceutical composition. In certain embodiments, the composition of the invention is formulated as a milk-based product. The term "milk-based product" means any liquid or semi-solid milk- or whey-based product having a varying fat content. The milk-based product can be, e.g., cow's milk, goat's milk, sheep's milk, skimmed milk, whole milk, milk recombined from powdered milk and whey without any processing, or a processed product, such as yoghurt, curdled milk, curd, sour milk, sour whole milk, butter milk and other sour milk products. Another important group includes milk beverages, such as whey beverages, fermented milks, condensed milks, infant or baby milks; flavoured milks, ice cream; milk-containing food such as sweets.

In some embodiments, the compositions of the invention comprise one or more bacterial strains of the genus *Blautia* and do not contain bacteria from any other genera, or which comprise only de minimis or biologically irrelevant amounts of bacteria from another genera. Thus, in some embodiments, the invention provides a composition comprising one or more bacterial strains of the genus *Blautia*, which does not contain bacteria from any other genera or which comprises only de minimis or biologically irrelevant amounts of bacteria from another genera, for use in therapy.

In some embodiments, the compositions of the invention comprise one or more bacterial strains of the species *Blautia stercoris* or *Blautia wexlerae* and do not contain bacteria from any other species, or which comprise only de minimis or biologically irrelevant amounts of bacteria from another species.

Thus, in some embodiments, the invention provides a composition comprising one or more bacterial strains of the species *Blautia stercoris* or *Blautia wexlerae*, which does not contain bacteria from any other species or which comprises only de minimis or biologically irrelevant amounts of bacteria from another species, for use in therapy.

In some embodiments, the compositions of the invention comprise one or more bacterial strains of the species *Blautia hydrogenotrophica* and do not contain bacteria from any other species, or which comprise only de minimis or biologically irrelevant amounts of bacteria from another species. Thus, in some embodiments, the invention provides a composition comprising one or more bacterial strains of the species *Blautia hydrogenotrophica*, which does not contain bacteria from any other species or which comprises only de minimis or biologically irrelevant amounts of bacteria from another species, for use in therapy.

In some embodiments, the compositions of the invention comprise one or more bacterial strains of the species *Blautia stercoris* or *Blautia wexlerae* and do not contain bacteria from any other *Blautia* species, or which comprise only de minimis or biologically irrelevant amounts of bacteria from another *Blautia* species. Thus, in some embodiments, the invention provides a composition comprising one or more bacterial strains of the species *Blautia stercoris* or *Blautia wexlerae*, which does not contain bacteria from any other *Blautia* species or which comprises only de minimis or biologically irrelevant amounts of bacteria from another *Blautia* species, for use in therapy.

In some embodiments, the compositions of the invention comprise one or more bacterial strains of the species *Blautia hydrogenotrophica* and do not contain bacteria from any other *Blautia* species, or which comprise only de minimis or biologically irrelevant amounts of bacteria from another *Blautia* species. Thus, in some embodiments, the invention provides a composition comprising one or more bacterial strains of the species *Blautia hydrogenotrophica*, which does not contain bacteria from any other *Blautia* species or which comprises only de minimis or biologically irrelevant amounts of bacteria from another *Blautia* species, for use in therapy.

In certain embodiments, the compositions of the invention contain a single bacterial strain or species and do not contain any other bacterial strains or species. Such compositions may comprise only de minimis or biologically irrelevant amounts of other bacterial strains or species. Such compositions may be a culture that is substantially free from other species of organism.

In some embodiments, the invention provides a composition comprising a single bacterial strain of the genus *Blautia*, which does not contain bacteria from any other strains or which comprises only de minimis or biologically irrelevant amounts of bacteria from another strain for use in therapy.

In some embodiments, the invention provides a composition comprising a single bacterial strain of the species *Blautia stercoris* or *Blautia wexlerae*, which does not contain bacteria from any other strains or which comprises only de minimis or biologically irrelevant amounts of bacteria from another strain for use in therapy.

In some embodiments, the invention provides a composition comprising a single bacterial strain of the species *Blautia hydrogenotrophica*, which does not contain bacteria from any other strains or which comprises only de minimis or biologically irrelevant amounts of bacteria from another strain for use in therapy.

In some embodiments, the compositions of the invention comprise more than one bacterial strain. For example, in some embodiments, the compositions of the invention comprise more than one strain from within the same species (e.g. more than 1, 2, 3, 4, 5, 6, 7, 8, 9, 10, 15, 20, 25, 30, 35, 40 or 45 strains), and, optionally, do not contain bacteria from any other species. In some embodiments, the compositions of the invention comprise less than 50 strains from within the same species (e.g. less than 45, 40, 35, 30, 25, 20, 15, 12, 10, 9, 8, 7, 6, 5, 4 or 3 strains), and, optionally, do not contain bacteria from any other species. In some embodiments, the compositions of the invention comprise 1-40, 1-30, 1-20, 1-19, 1-18, 1-15, 1-10, 1-9, 1-8, 1-7, 1-6, 1-5, 1-4, 1-3, 1-2, 2-50, 2-40, 2-30, 2-20, 2-15, 2-10, 2-5, 6-30, 6-15, 16-25, or 31-50 strains from within the same species and, optionally, do not contain bacteria from any other species. The invention comprises any combination of the foregoing.

In some embodiments, the composition comprises a microbial consortium. For example, in some embodiments, the composition comprises the *Blautia* bacterial strain as part of a microbial consortium. For example, in some embodiments, the *Blautia* bacterial strain is present in combination with one or more (e.g. at least 2, 3, 4, 5, 10, 15 or 20) other bacterial strains from other genera with which it can live symbiotically in vivo in the intestine. For example, in some embodiments, the composition comprises a bacterial strain of *Blautia* in combination with a bacterial strain from a different genus. In some embodiments, the microbial consortium comprises two or more bacterial strains obtained from a faeces sample of a single organism, e.g. a human. In some embodiments, the microbial consortium is not found together in nature. For example, in some embodiments, the microbial consortium comprises bacterial strains obtained from faeces samples of at least two different organisms. In some embodiments, the two different organisms are from the same species, e.g. two different humans. In some embodiments, the two different organisms are an infant human and an adult human. In some embodiments, the two different organisms are a human and a non-human mammal.

In some embodiments, the composition of the invention additionally comprises a bacterial strain that has the same safety and therapeutic efficacy characteristics as strain MRX006, but which is not MRX006 deposited as NCIMB 42381, or which is not a *Blautia stercoris*. In some embodiments, the composition of the invention additionally comprises a bacterial strain that has the same safety and therapeutic efficacy characteristics as strain MRX008, but which is not MRX008 deposited as NCIMB 42486, or which is not a *Blautia wexlerae*.

In some embodiments, the composition of the invention additionally comprises a bacterial strain that has the same safety and therapeutic efficacy characteristics as the *Blautia hydrogenotrophica* strain deposited as DSM 14294, but which is not the *Blautia hydrogenotrophica* strain deposited as DSM 14294, or which is not a *Blautia hydrogenotrophica*.

In some embodiments, the composition of the invention does not comprise a bacterial strain of the genus *Bacillus*. In some embodiments, the composition of the invention does not comprise *Bacillus subtilis* and/or does not comprise *Bacillus coagulans*. In some embodiments, the CNS disorder to be treated by the composition of the invention is not bipolar disorder. In some embodiments, the patient to be treated by the composition of the invention does not have a fungal infection. In some embodiments, the patient to be treated by the composition of the invention does not suffer from candidiasis. In some embodiments, the patient to be treated by the composition of the invention has not been diagnosed as having a fungal infection and/or has not been diagnosed as suffering from candidiasis. In preferred such embodiments, the patient to be treated by the composition of the invention has never been diagnosed as having a fungal infection and/or has never been diagnosed as suffering from candidiasis.

In some embodiments in which the composition of the invention comprises more than one bacterial strain, species or genus, the individual bacterial strains, species or genera may be for separate, simultaneous or sequential administration. For example, the composition may comprise all of the more than one bacterial strain, species or genera, or the bacterial strains, species or genera may be stored separately and be administered separately, simultaneously or sequentially. In some embodiments, the more than one bacterial strains, species or genera are stored separately but are mixed together prior to use.

In some embodiments, the bacterial strain for use in the invention is obtained from human adult faeces. In some embodiments in which the composition of the invention comprises more than one bacterial strain, all of the bacterial strains are obtained from human adult faeces or if other bacterial strains are present they are present only in de minimis amounts. The bacteria may have been cultured subsequent to being obtained from the human adult faeces and being used in a composition of the invention.

As mentioned above, in some embodiments, the one or more *Blautia* bacterial strains is/are the only therapeutically active agent(s) in a composition of the invention. In some embodiments, the bacterial strain(s) in the composition is/are the only therapeutically active agent(s) in a composition of the invention.

The compositions for use in accordance with the invention may or may not require marketing approval.

In certain embodiments, the invention provides the above pharmaceutical composition, wherein said bacterial strain is lyophilised. In certain embodiments, the invention provides the above pharmaceutical composition, wherein said bacterial strain is spray dried. In certain embodiments, the invention provides the above pharmaceutical composition, wherein the bacterial strain is lyophilised or spray dried and wherein it is live. In certain embodiments, the invention provides the above pharmaceutical composition, wherein the bacterial strain is lyophilised or spray dried and wherein it is viable. In certain embodiments, the invention provides the above pharmaceutical composition, wherein the bacterial strain is lyophilised or spray dried and wherein it is capable of partially or totally colonising the intestine. In certain embodiments, the invention provides the above pharmaceutical composition, wherein the bacterial strain is lyophilised or spray dried and wherein it is viable and capable of partially or totally colonising the intestine.

In some cases, the lyophilised or spray dried bacterial strain is reconstituted prior to administration. In some cases, the reconstitution is by use of a diluent described herein.

The compositions of the invention can comprise pharmaceutically acceptable excipients, diluents or carriers.

In certain embodiments, the invention provides a pharmaceutical composition comprising: a bacterial strain as used in the invention; and a pharmaceutically acceptable excipient, carrier or diluent; wherein the bacterial strain is in an amount sufficient to treat a disorder when administered to a subject in need thereof; and wherein the disorder is selected from the group consisting of: autism spectrum disorders (ASDs); child developmental disorder; obsessive compulsive disorder (OCD); major depressive disorder; depression; seasonal affective disorder; anxiety disorders; schizophrenia spectrum disorders; schizophrenia; bipolar disorder; psychosis; mood disorder; chronic fatigue syndrome (myalgic encephalomyelitis); stress disorder; post-traumatic stress disorder; dementia; Alzheimer's; Parkinson's disease; and/or chronic pain; motor neuron disease; Huntington's disease; Guillain-Barre syndrome and/or meningitis.

In certain embodiments, the invention provides pharmaceutical composition comprising: a bacterial strain as used in the invention; and a pharmaceutically acceptable excipient, carrier or diluent; wherein the bacterial strain is in an amount sufficient to treat or prevent a central nervous system disorder or condition, in particular central nervous system disorder or condition mediated by the microbiota-gut-brain axis. In preferred embodiments, said disease or condition is selected from the group consisting of: autism spectrum disorders (ASDs); child developmental disorder; obsessive compulsive disorder (OCD); major depressive disorder; depression; seasonal affective disorder; anxiety disorders; schizophrenia spectrum disorders; schizophrenia; bipolar disorder; psychosis; mood disorder; chronic fatigue syndrome (myalgic encephalomyelitis); stress disorder; post-traumatic stress disorder; dementia; Alzheimer's; Parkinson's disease; and/or chronic pain. In further embodiments, the compositions of the invention may be useful for treating or preventing motor neuron disease; Huntington's disease; Guillain-Barre syndrome and/or meningitis.

In certain embodiments, the invention provides the above pharmaceutical composition, wherein the amount of the bacterial strain is from about $1\times10^3$ to about $1\times10^{11}$ colony forming units per gram with respect to a weight of the composition.

In certain embodiments, the invention provides the above pharmaceutical composition, wherein the composition is administered at a dose of 1 g, 3 g, 5 g or 10 g.

In certain embodiments, the invention provides the above pharmaceutical composition, wherein the composition is administered by a method selected from the group consisting of oral, rectal, subcutaneous, nasal, buccal, and sublingual.

In certain embodiments, the invention provides the above pharmaceutical composition, comprising a carrier selected from the group consisting of lactose, starch, glucose, methyl cellulose, magnesium stearate, mannitol and sorbitol.

In certain embodiments, the invention provides the above pharmaceutical composition, comprising a diluent selected from the group consisting of ethanol, glycerol and water.

In certain embodiments, the invention provides the above pharmaceutical composition, comprising an excipient selected from the group consisting of starch, gelatin, glucose, anhydrous lactose, free-flow lactose, beta-lactose, corn sweetener, acacia, tragacanth, sodium alginate, carboxymethyl cellulose, polyethylene glycol, sodium oleate, sodium stearate, magnesium stearate, sodium benzoate, sodium acetate and sodium chloride.

In certain embodiments, the invention provides the above pharmaceutical composition, further comprising at least one of a preservative, an antioxidant and a stabilizer.

In certain embodiments, the invention provides the above pharmaceutical composition, comprising a preservative selected from the group consisting of sodium benzoate, sorbic acid and esters of p-hydroxybenzoic acid.

In certain embodiments, the invention provides the above pharmaceutical composition, wherein when the composition is stored in a sealed container at about 4.0 or about 25.0 and the container is placed in an atmosphere having 50% relative humidity, at least 80% of the bacterial strain as measured in colony forming units, remains after a period of at least about: 1 month, 3 months, 6 months, 1 year, 1.5 years, 2 years, 2.5 years or 3 years.

In some embodiments, the composition of the invention is provided in a sealed container comprising a composition as described herein. In some embodiments, the sealed container is a sachet or bottle. In some embodiments, the composition of the invention is provided in a syringe comprising a composition as described herein.

The composition of the present invention may, in some embodiments, be provided as a pharmaceutical formulation. For example, the composition may be provided as a tablet or capsule. In some embodiments, the capsule is a gelatine capsule ("gel-cap").

In some embodiments, the compositions of the invention are administered orally. Oral administration may involve swallowing, so that the compound enters the gastrointestinal tract, and/or buccal, lingual, or sublingual administration by which the compound enters the blood stream directly from the mouth.

Pharmaceutical formulations suitable for oral administration include solid plugs, solid microparticulates, semi-solid and liquid (including multiple phases or dispersed systems) such as tablets; soft or hard capsules containing multi- or nano-particulates, liquids (e.g. aqueous solutions), emulsions or powders; lozenges (including liquid-filled); chews; gels; fast dispersing dosage forms; films; ovules; sprays; and buccal/mucoadhesive patches.

In some embodiments the pharmaceutical formulation is an enteric formulation, i.e. a gastro-resistant formulation (for example, resistant to gastric pH) that is suitable for delivery of the composition of the invention to the intestine by oral administration. Enteric formulations may be particularly useful when the bacteria or another component of the composition is acid-sensitive, e.g. prone to degradation under gastric conditions.

In some embodiments, the enteric formulation comprises an enteric coating. In some embodiments, the formulation is an enteric-coated dosage form. For example, the formulation may be an enteric-coated tablet or an enteric-coated capsule, or the like. The enteric coating may be a conventional enteric coating, for example, a conventional coating for a tablet, capsule, or the like for oral delivery. The formulation may comprise a film coating, for example, a thin film layer of an enteric polymer, e.g. an acid-insoluble polymer.

In some embodiments, the enteric formulation is intrinsically enteric, for example, gastro-resistant without the need for an enteric coating. Thus, in some embodiments, the formulation is an enteric formulation that does not comprise an enteric coating. In some embodiments, the formulation is a capsule made from a thermogelling material. In some embodiments, the thermogelling material is a cellulosic material, such as methylcellulose, hydroxymethylcellulose or hydroxypropylmethylcellulose (HPMC). In some embodiments, the capsule comprises a shell that does not contain any film forming polymer. In some embodiments, the capsule comprises a shell and the shell comprises hydroxypropylmethylcellulose and does not comprise any film forming polymer (e.g. see [43]). In some embodiments, the formulation is an intrinsically enteric capsule (for example, Vcaps® from Capsugel).

In some embodiments, the formulation is a soft capsule. Soft capsules are capsules which may, owing to additions of softeners, such as, for example, glycerol, sorbitol, maltitol and polyethylene glycols, present in the capsule shell, have a certain elasticity and softness. Soft capsules can be produced, for example, on the basis of gelatine or starch. Gelatine-based soft capsules are commercially available from various suppliers. Depending on the method of administration, such as, for example, orally or rectally, soft capsules can have various shapes, they can be, for example, round, oval, oblong or torpedo-shaped. Soft capsules can be produced by conventional processes, such as, for example, by the Scherer process, the Accogel process or the droplet or blowing process.

Culturing Methods

The bacterial strains for use in the present invention can be cultured using standard microbiology techniques as detailed in, for example, references [44], [ ] and [46].

The solid or liquid medium used for culture may be YCFA agar or YCFA medium. YCFA medium may include (per 100 ml, approximate values): Casitone (1.0 g), yeast extract (0.25 g), $NaHCO_3$ (0.4 g), cysteine (0.1 g), $K_2HPO_4$ (0.045 g), $KH_2PO_4$ (0.045 g), NaCl (0.09 g), $(NH_4)_2SO_4$ (0.09 g), $MgSO_4.7H_2O$ (0.009 g), $CaCl_2$ (0.009 g), resazurin (0.1 mg), hemin (1 mg), biotin (1 µg), cobalamin (1 µg), p-aminobenzoic acid (3 µg), folic acid (5 µg), and pyridoxamine (15 µg).

Bacterial Strains for Use in Vaccine Compositions

The inventors have identified that the bacterial strains of the invention are useful for treating or preventing central nervous system disorders or conditions, in particular central nervous system disorders or conditions mediated by the microbiota-gut-brain axis. This is likely to be a result of the effect that the bacterial strains of the invention have on the host central, autonomic and/or enteric nervous system; the activity of the HPA pathway; the neuroimmune and neuroendocrine pathways; and the level of commensal metabolites in the host gastrointestinal tract and/or gastrointestinal permeability of the host. Therefore, the compositions of the invention may also be useful for preventing central nervous system disorders or conditions, in particular central nervous system disorders or conditions mediated by the microbiota-gut-brain axis, when administered as vaccine compositions. In certain such embodiments, the bacterial strains of the invention are viable. In certain such embodiments, the bacterial strains of the invention are capable of partially or totally colonising the intestine. In certain such embodiments, the bacterial strains of the invention are viable and capable of partially or totally colonising the intestine. In other certain such embodiments, the bacterial strains of the invention may be killed, inactivated or attenuated. In certain such embodiments, the compositions may comprise a vaccine adjuvant. In certain embodiments, the compositions are for administration via injection, such as via subcutaneous injection.

General

The practice of the present invention will employ, unless otherwise indicated, conventional methods of chemistry, biochemistry, molecular biology, immunology and pharmacology, within the skill of the art. Such techniques are explained fully in the literature. See, e.g., references [47] and [48]-[54], etc.

The term "comprising" encompasses "including" as well as "consisting" e.g. a composition "comprising" X may consist exclusively of X or may include something additional e.g. X+Y.

The term "about" in relation to a numerical value x is optional and means, for example, x±10%.

In certain embodiments the term "modulate" means increase or activate. In alternative embodiments, the term "modulate" means decrease or suppress.

The word "substantially" does not exclude "completely" e.g. a composition which is "substantially free" from Y may be completely free from Y. Where necessary, the word "substantially" may be omitted from the definition of the invention.

References to a percentage sequence identity between two nucleotide sequences means that, when aligned, that percentage of nucleotides are the same in comparing the two sequences. This alignment and the percent homology or sequence identity can be determined using software programs known in the art, for example those described in section 7.7.18 of ref. [55]. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref [56].

Unless specifically stated, a process or method comprising numerous steps may comprise additional steps at the beginning or end of the method, or may comprise additional intervening steps. Also, steps may be combined, omitted or performed in an alternative order, if appropriate.

Various embodiments of the invention are described herein. It will be appreciated that the features specified in each embodiment may be combined with other specified features, to provide further embodiments. In particular, embodiments highlighted herein as being suitable, typical or preferred may be combined with each other (except when they are mutually exclusive).

MODES FOR CARRYING OUT THE INVENTION

The present study aimed to assess the effect of live biotherapeutics on the treatment of psychiatric and neurological disorders in two different mouse models that display behavioural characteristics associated with neurodevelopmental and psychiatric disorders. In particular, the study focuses on autistic-related behaviour in (i) C57BL/6 wt mouse model, (ii) a BTBR inbred, genetically modified mouse model and (iii) a maternal immune activation (MIA) mouse model. The effects of chronic MRX006 versus vehicle treatment across anxiety, depression, and cognitive and social domains of behaviour in the three mouse models were investigated. In addition, physiological and anatomical analyses were performed as well as detection of circulating cytokine and oxytocin levels.

The EMA Guidelines on the clinical development of medicinal products for the treatment of autism spectrum disorder state that, due to the heterogeneity of the diseases, it may not be possible to achieve a significant effect on all core symptoms with a single compound, and so short term efficacy has to be demonstrated on at least one core symptom. The live biotherapeutics tested in the Examples have shown effective treatment of at least one core symptom of autistic spectrum disorder, so these strains and related *Blautia* strains are expected to be effective against human disease. Similarly, other central nervous system disorders or conditions display complex pathology with multiple different symptoms, and have few approved treatments. Therefore, it is understood that an effective treatment does not need to treat all symptoms of a central nervous system disorder or condition. A treatment would be considered therapeutically useful if it treated one of the symptoms associated with a central nervous system disorder or condition.

Example 1—Assessing Anxiety, Depression, Cognitive and Social Domains of Behaviour in C57BL/6 Mice Example 1a—Materials and Methods for the C57BL/6 Mice Experiments Mice Male C57BL/6 mice were purchased from Harlan UK. The animals were housed in a temperature—and humidity—controlled room on a 12 hr dark cycle (lights on from 7:00-19:00 hr). All experiments were conducted in accordance with the European Directive 2010/63/EEC, the requirements of S.I. No 543 of 2012, and approved by the Animal Experimentation Ethics Committee of University College Cork.

Strain

MRX006: *Blautia stercoris* bacterium deposited under accession number NCIMB 42381. Biotherapeutic was provided in glycerol stock. Live biotherapeutics were grown in the facility in anaerobic conditions.

Live Biotherapeutic Administration

Dosing with MRX006 or vehicle (control) commenced when the mice were 7 weeks old. These mice were treated once daily with MRX006 or phosphate buffer solution (PBS) for 4 weeks before the beginning of the behavioural battery. Mice were further treated once daily during the behavioural battery. MRX006 ($1\times10^9$ CFU oral administration) was dissolved in PBS prior to administration.

Administration Schedule

The treatment groups for the study are shown below. The vehicle for oral administration is PBS. Daily oral administration occurs via oral gavage.

| Group | Treatment | Number |
|---|---|---|
| 1 | Naïve (no gavage) | 12 |
| 2 | Control (PBS, oral gavage) | 12 |
| 3 | MRX006 (oral gavage in PBS) | 12 |

The naïve group was not handled until the beginning of the behavioural battery.

Fecal Collection

Fresh fecal samples were collected from individual mice every week until the end of the study. At least 20 mg of fresh faeces were placed in a microcentrifuge tube, place immediately on ice and then stored at −80° C.

Experimental Design and Methods

As outlined above, dosing with MRX006 commenced when the mice were 7 weeks old. The initial dosing took place for 4 weeks before the behavioural experiments. The behavioural battery occurred in the following order: marble burying and 3 chamber tests at week 5; the elevated plus maze and tail suspension tests at week 6; the open field and novel object recognition tests at week 8; the stress-induced hyperthermia test at week 9; the fear conditioning test at week 10; and the forced swim test at week 11. The fluorescein gut permeability assay was performed at week 9. Finally, in weeks 12, the mice were culled and dissected for brain, proximal and distal colon, adrenal and spleen regions, along with plasma samples.

Graphical Design and Statistical Analysis

All graphs were generated on graphpad prism software (version 5). Data were analysed using IBM SPSS Statistic 22.0 (EEUU). Data distribution was analysed using the Kolmogorov-Smirnov normality test. Data comparing vehicle group versus MRX006 groups were analysed using two-way ANOVA and Fisher's least significant difference (LSD) post hoc test. Data comparing vehicle group versus naïve mice were analysed by unpaired Student t test. Non-normally distributed data were analysed by the Kruskal-Wallis and non-parametric Mann-Whitney U test. $P<0.05$ was the criterion for statistical significance.

Example 1b—Assessment of Social Interaction Behaviour—the Three Chamber Tests Rationale The 3-Chamber Social Interaction Test (3-CSIT) is a well validated ethologically relevant model that assesses social interaction between sex-matched conspecifics and allows for readouts of social novelty and social preference in mice. The test is used to characterize and demonstrate changes in this behavioural readout. The test allows mice to freely explore between an inanimate object or sex-matched conspecific mice.

In addition, the 3-chamber test (3-CHT) is a test used to assess cognition in the form of general sociability and interest in social novelty in rodent models. Rodents normally prefer to spend more time with another rodent (sociability) than with an object. Moreover, rodents prefer to investigate a novel mouse versus a familiar mice (social novelty). Based on these inclinations, the 3-CHT can help identify rodents with deficits in sociability and/or social novelty.

Methods

Animals are placed in a rectangular apparatus divided into three chambers (left and right and a smaller centre chamber) by partitions with small circular openings allowing easy access to all compartments. The test is composed of three sequential 10 min trials: (1) habituation (the test animal is allowed to explore the three empty chambers); (2) sociability (an unfamiliar animal is placed in an inner mesh wire cage in either the left or right chambers); (3) social novelty preference (a novel animal is placed into the previously empty inner cage in the chamber, opposite the now familiar animal). Naive animals should have no preference for either chamber in the habituation phase, a preference for the mouse in the sociability phase, and a preference for the novel mouse in the social novelty phase. An increase in the discrimination ratio would suggest an increase in social behaviour. All animals are age- and sex-matched, with each chamber cleaned and lined with fresh bedding after each 30 minute trial. For each of the three stages, behaviour is recorded by a video camera mounted above the apparatus.

Results

Figure 1B:
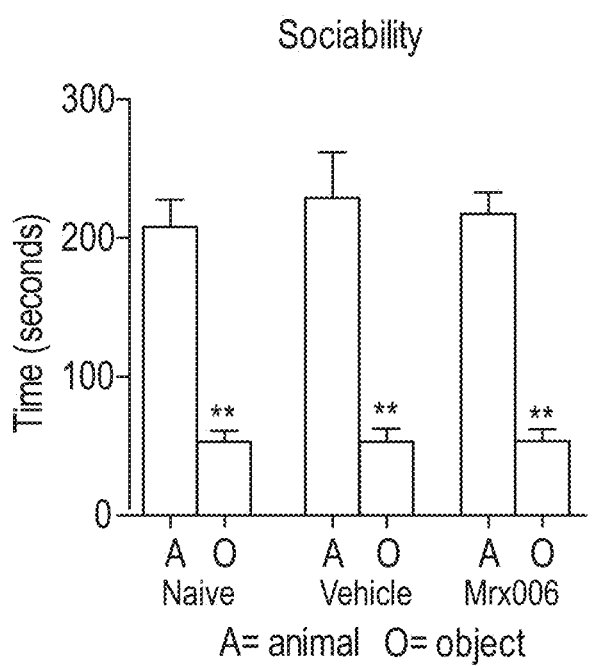

Student t test within groups revealed that all groups spent more time investigating a mouse versus an object (**$p<0.01$) suggesting no deficits in sociability (FIG. 1). Daily gavage did not affect sociability. Interestingly, MRX006 enhanced the time spent investigating a novel versus a familiar mice, suggesting increased social novelty ($p<0.05$; FIG. 1).

Conclusions

Chronic treatment with MRX006 enhanced preference for social novelty in C57BL/6 mice in the three chamber test.

Example 1c—Assessing Depression-Like Behaviour—the Forced Swim Test (FST)

Rationale

The forced swim test (FST) is the most widely used experimental paradigm to assess antidepressant activity. naïve animals will display escape behaviour in the form of swimming, climbing and diving before adapting an immobile floating posture. The duration of immobility is indicative of behavioural despair. Antidepressant drugs decrease the time spent immobile in this test.

Methods

Mice are forced to swim for 6 min in a glass cylinder (24×21 cm) filled with 23-25° C. tap water to a depth of 17 cm. The FST was videotaped from a ceiling camera. The behavioural parameter scored is immobility during the last 4 min of the 6-min test.

Results

Figure 2:
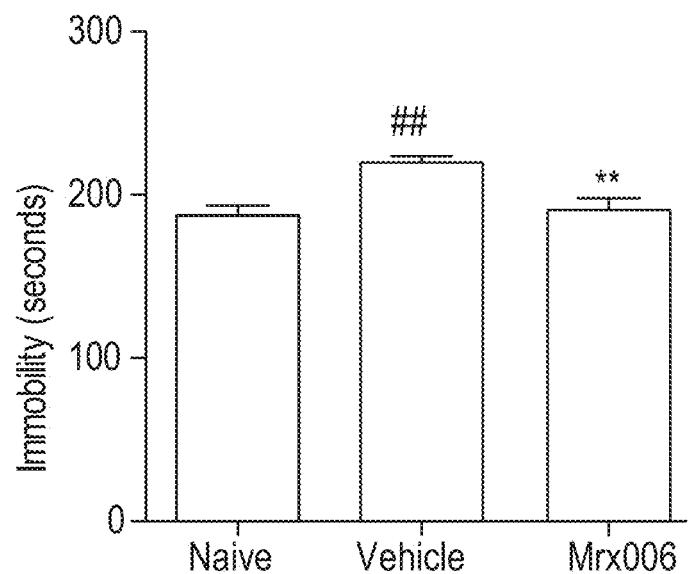
FIG. 2: Effect of treatment with MRX006 on C57Bl/6 mice in the forced swim test. Mrx006 significantly different to the vehicle group $**p<0.01$; Vehicle group significantly different to the naïve group $\#\#p<0.01$.

Daily gavage increased immobility time suggesting depressive-like behaviour compared to naïve mice (t Student test, t (190=4.565; p<0.01; FIG. 2). Chronic treatment with MRX006 significantly reduced immobility suggesting antidepressant-like effects compared to the vehicle group (F (2.29)=14.992; **p<0.01).

Conclusions

Chronic treatment with MXR006 induced antidepressant-like behaviour in the forced swim test.

Example 1d—Assessing Depression-Like Behaviour—the Tail Suspension Test

Rationale

The tail suspension test is a well-characterized test used to assess antidepressant-like behaviour. The time spend immobile is an index of depression-like behaviour. Treatment with antidepressant drugs decreases the time spent immobile.

Methods

Mice are suspended to an elevated bar (60 cm) by a piece of adhesive tape attached 1 cm before the tip of their tail for a period of 6 min. The mice are suspended in such a way that they cannot escape or hold on to nearby surfaces. During this test, six minutes in duration, the resulting escape oriented behaviours are quantified. The behavioural parameter scored is time spent immobile. The test was video-recorded by a tripod camera and the time of immobility was scored manually by an investigator blind to the experimental conditions.

Results

Figure 3:
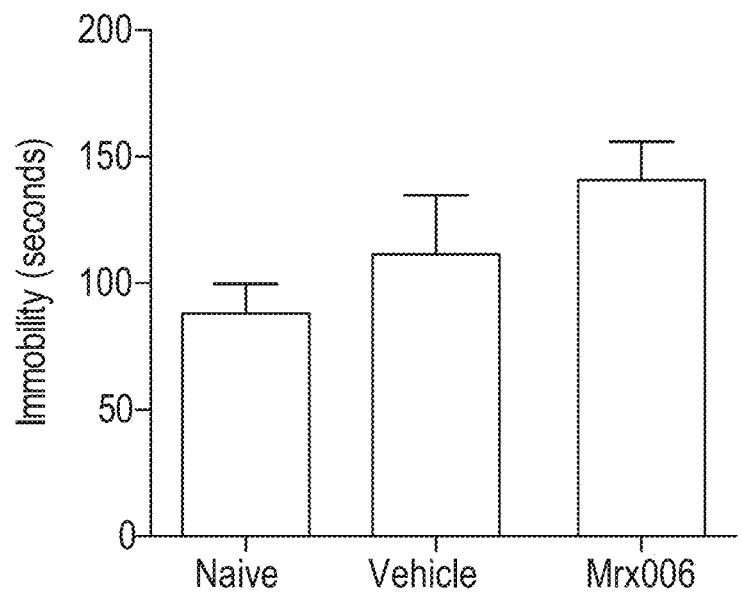
FIG. 3: Effect of treatment with MRX006 on C57Bl/6 mice in the tail suspension test.

Daily handling for gavage (Student t test, t (20)=0.9405; p=0.3582) and chronic treatment with MRX006 (one-way ANOVA, F (2.30)=2.014; p=0.152) did not induce any significant effect in the tail suspension test (FIG. 3).

Conclusion

Chronic treatment with MRX006 did not induce any observable anti-depressant-like behaviour in C57BL/6 mice in the tail suspension test.

Example 1e—Assessing Cognition—the Fear Conditioning Test Rationale

Contextual fear conditioning is used as a measure of hippocampus-dependent memory. Fear conditioning is a form of an associative learning which measures the freezing response displayed by the animal to an unconditioned stimuli (US), such as a shock with a conditioned stimulus (CS), a particular tone or light or smell. The measurement of freezing levels was used to assess the animal response to the US and CS stimuli. This test measures how efficiently the mice forget what they have acquired on the acquisition day. The test assesses the anxiety of mice towards conditioned stimuli associated with unconditioned stimuli and the speed at which the mice show reduced anxiety and/or stress (freezing levels) in the presence of conditioned stimuli in the repeated absence of paired unconditioned stimuli.

Methods

The apparatus for this test consisted of chambers with a light above. Each chamber is located inside a larger chamber, which protects from outside light and noise. On the first day (training or acquisition stage), mice were placed into the chamber and their freezing behaviour was recorded for 3 min (baseline), followed by up to 6 light/tone [conditioned stimulus (CS-30 s)] and footshock [unconditioned stimulus (US-2 s)] pairings with an interval of up to 2 min. Pairings consisted of the cue [e.g., a combined light (~260 lx) and tone exposure (80 dB)] for 20 s and an electric footshock during the last 2 s of the cue. Foot shock increases freezing behaviour. The intensity of the current was 0.6 mA. The minimal current that induces a freezing response was used. Two minutes after the last pairing, mice were returned to their normal housing conditions. At 24 and 48 h after conditioning (days 2 (retrieval stage) and 3 (extinction stage), respectively), the same experimental procedure was repeated in absence of footshocks to test for memory retention and extinction of the conditioned fear memory (extinction phase). Contextual memory retention is characterized by freezing behaviour when the animal is placed in the context (i.e. the footshock chamber) in the absence of a foot shock.

Results

Figure 4A:
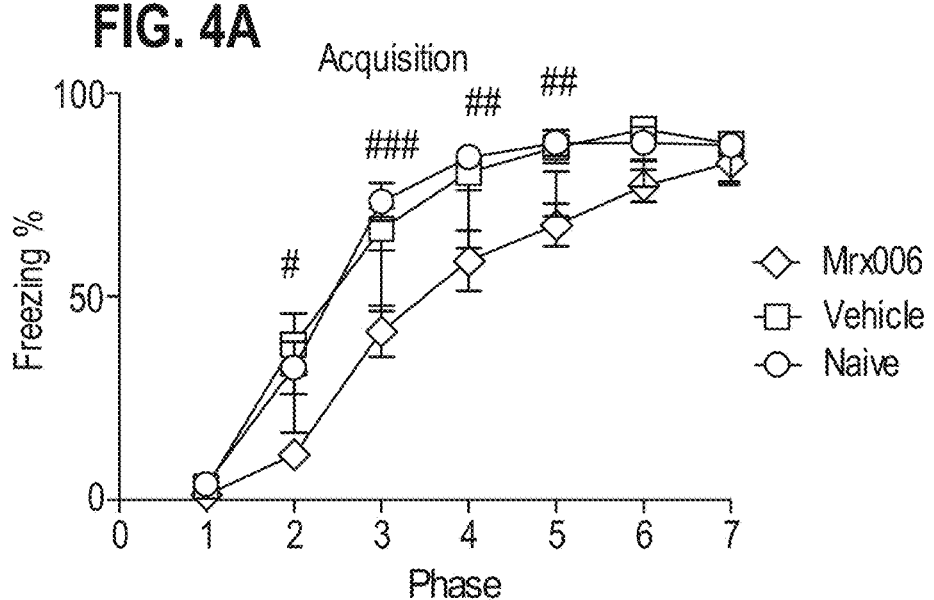
FIGS. 4A-4C: Effect of treatment with MRX006 on C57Bl/6 mice in the fear conditioning test. *MRX006 significantly different to the Vehicle group; # Vehicle significantly different to the naïve group; $*p<0.05$, $\#p<0.05$, $\#\#p<0.01$, $\#\#\#p<0.001$.
Figure 4B:
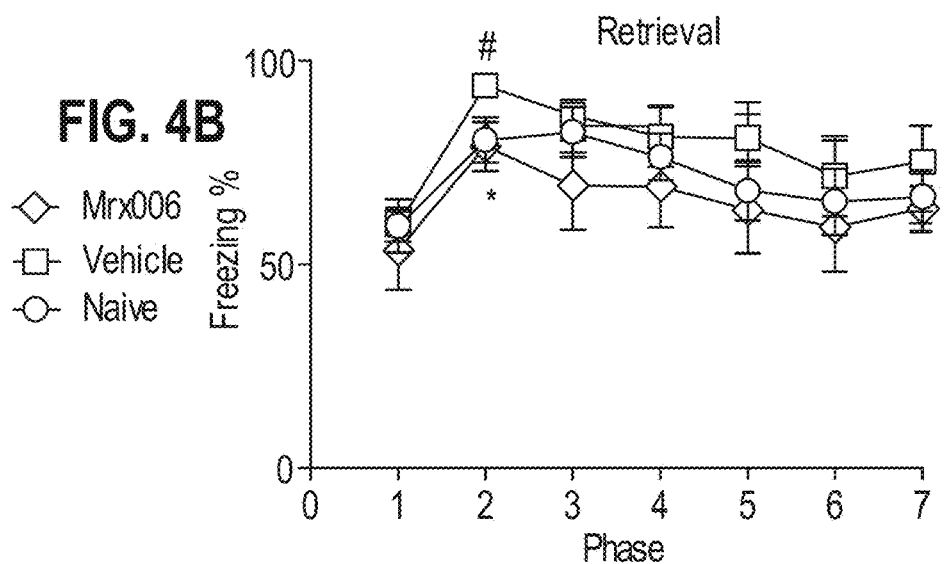
Figure 4C:
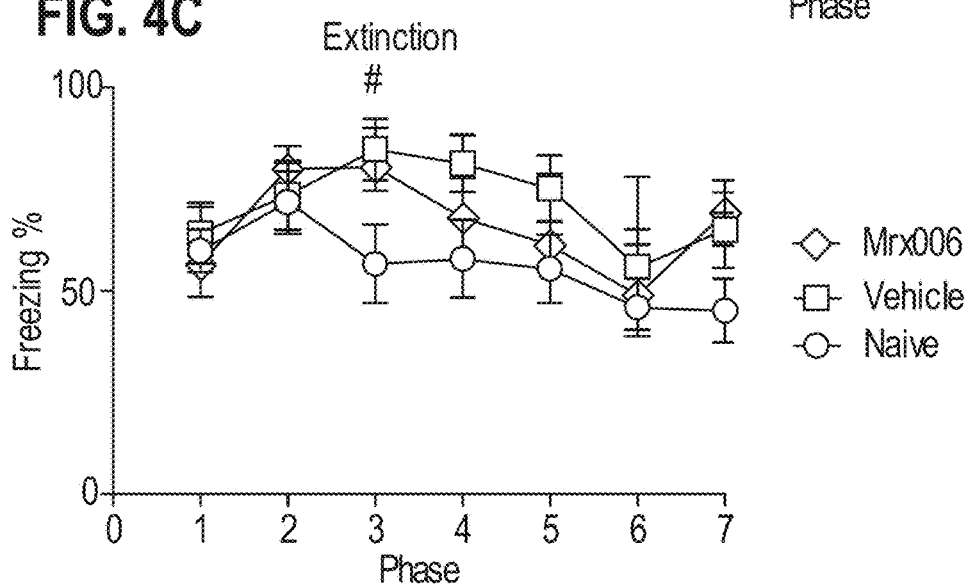

Freezing levels were measured in the acquisition phase (exposure to both CS and US coupled together), retrieval and extinction phase (CS not coupled with US) (see FIG. 4). In this study, daily gavage induced a significant increase in freezing levels (phase 1 #p<0.05; phase 2 ###p<0.001; phase 3-4##p<0.01) in the acquisition phase as compared to naïve animals. MRX006 chronic treatment did not alter freezing levels when compared to the vehicle group during the acquisition phase. The acquisition phase was followed by the retrieval phase which took place 24 hours after the training session (CS not followed by US). The data showed a significant increase in freezing levels in phase 1 (exposure to the first tone) in the vehicle group compared to the naïve group (p<0.05). Interestingly, a significant reduction in the freezing levels was observed at phase 1 in MRX006-treated mice (*p<0.05) when compared to the vehicle group. Overall, in the retrieval phase, MRX006-treated displayed a trend for decreased freezing levels when compared to the vehicle group, suggesting that chronic treatment with MRX006 may enhance learning. The retrieval phase was followed by the extinction phase (24 hours later, CS and no US). This test measures how efficiently the mice forget what they have acquired on the acquisition day. In phase 3 of extinction phase the vehicle group displayed increased freezing levels when compared to the naïve group (p<0.05). Chronic treatment with MRX006 did not induce any significant change in the extinction phase.

Conclusion

Chronic treatment with MRX006 reduced freezing levels in the retrieval phase suggesting MRX006 may enhance learning. Overall, chronic treatment with MRX006 did not observably alter significantly fear conditioned behaviour.

Example 1f—Assessing Cognition—the Novel Object Recognition (NOR) Test

Rationale

The protocol used was adapted from Bevins and Besheer (2006), and used to test cognition, particularly recognition memory. This test is based on the spontaneous tendency of rodents to spend more time exploring a novel object than a familiar one. The choice to explore the novel object reflects the use of learning and recognition memory. In addition, improved memory is a reflection of reduced depression-like behaviour.

Methods

The protocol used was adapted from Bevins and Besheer (2006). It was conducted over 3 days. On Day 1, the animals were allowed to acclimate to the testing environment for 10 minutes, which was a large container equipped with an overhead camera. No bedding was used and the container was wiped with 70% ethanol between each animal. On Day 2, the animals were allowed to acclimate to the test apparatus for 10 minutes. Following this period, the animal was removed from the container and two identical objects were introduced to the environment. The animal was returned to the container and allowed to explore for a further 10 minutes. The objects were cleansed before each trial with a 70% ethanol solution. Following the training period, the rodent was removed from the environment for a delay period of 24 hours. On Day 3, the rodent was returned to the container, which this time contained only 1 familiar object from the day previous and 1 novel object. Activity of the animal with the 2 objects was recorded for 5 minutes. The amount of time that the rodent spent exploring each object was recorded by manual observation and a discrimination index (DI) value corresponding to time spent interacting with the novel object over total interaction time was generated. A decrease in DI compared to control rats indicates a deficit in this type of memory.

Results

Figure 5:
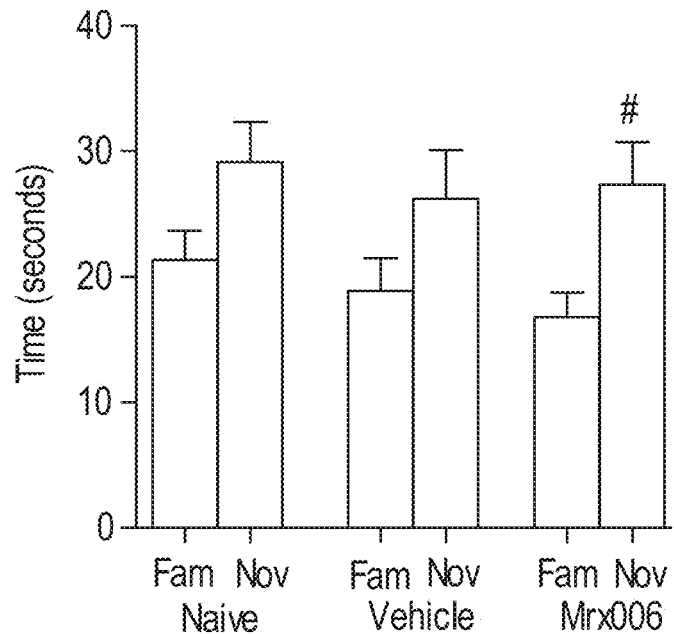
FIG. 5: Effect of treatment with MRX006 on C57Bl/6 mice in the novel object recognition test.
\# Significantly different vs. familiar object within groups; $\#p<0.05$.

Daily handling for gavage did not affect recognition memory in C57Bl/6 mice (FIG. 5). Indeed, both groups show a pattern for preference exploring more a novel versus a familiar object (although did not reach statistically significance). Mice chronically treated with MRX006 display significantly increased preference exploring a novel object versus a familiar one ($p<0.05$) (FIG. 5).

Conclusion

Chronic treatment with MRX006 resulted in C57Bl/6 mice spending significantly more time investigating a novel versus a familiar object suggesting enhance recognition memory.

Example 1 g—Assessing Anxiety-Like Behaviour—the Marble Burying Test

Rationale

The marble burying test is a useful model of neophobia, anxiety and obsessive compulsive behaviour. It is also used to test novel antidepressants, anxiolytics and antipsychotics. Mice pre-treated with pharmacological agents such as anxiolytics show decreased marble burying behaviour, compared to the control mice.

Methods

Mice were individually placed into a novel polypropylene cage (35×28×18.5 cm, L×W×H), containing standard rodent (hard wood) bedding (5 cm) and 20 marbles on top of it (five rows of marbles regularly spaced 2 cm away from the walls and 2 cm apart). Experiments were conducted under a light intensity of 1000 lux. 30 minutes later, mice were removed from these cages and the number of marbles buried for more than ⅔rds of their surface was scored.

Results

Figure 6:
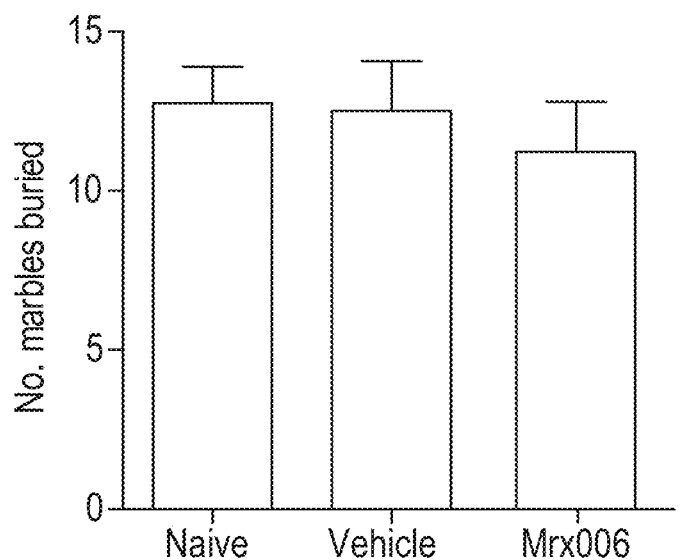
FIG. 6: Effect of treatment with MRX006 on C57Bl/6 mice in the marble burying test.
Figure 7A:
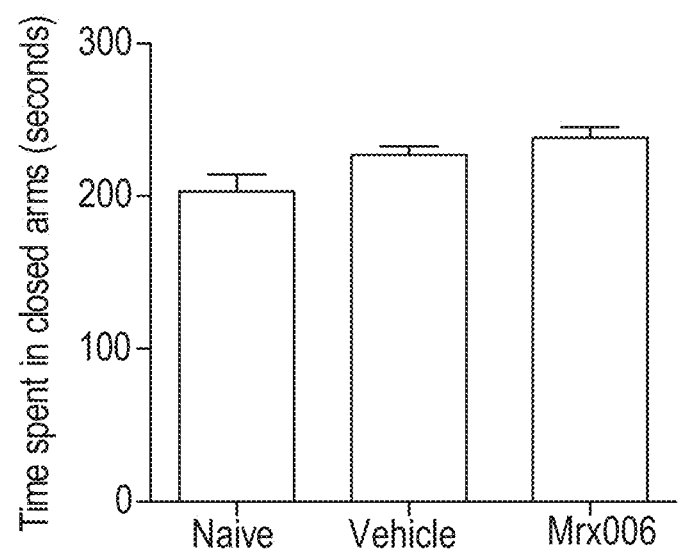
FIGS. 7A-7D: Effect of treatment with MRX006 on C57Bl/6 mice in the elevated plus maze test.
Figure 7B:
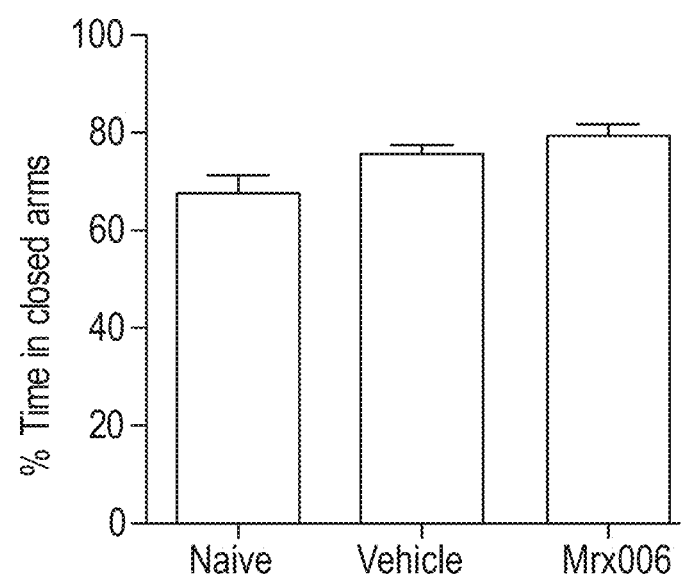
Figure 7C:
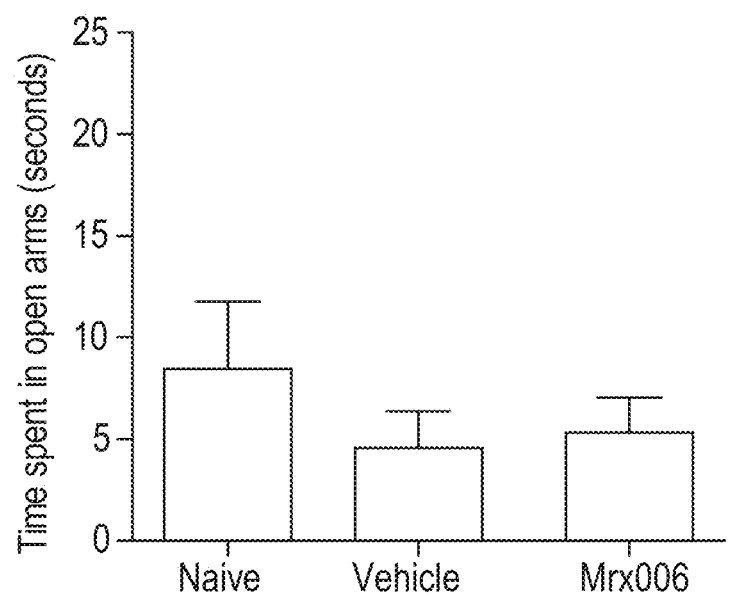
Figure 7D:
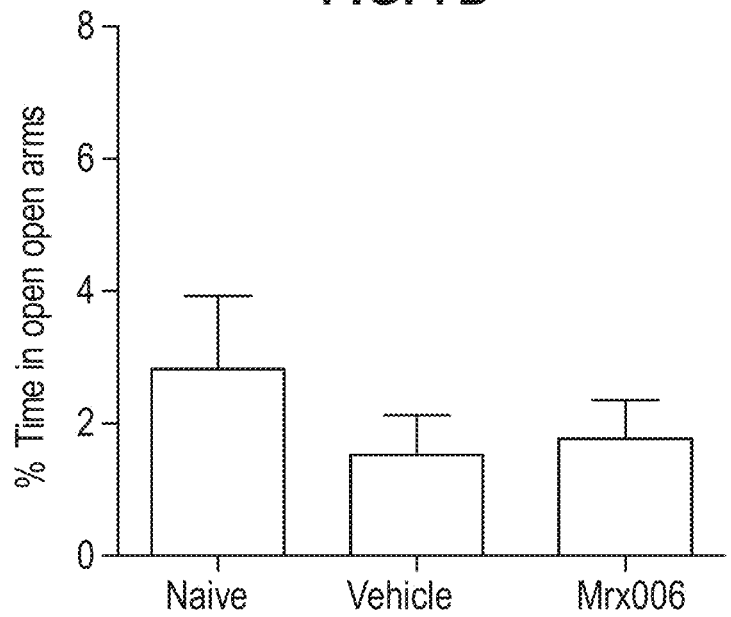

Student t test (vehicle versus naïve; $t(20)=0.1308$; $p=0.8973$) and one way ANOVA analysis ($F(2.38)=0.992$; $p=0.384$) revealed that neither chronic treatment with MRX006 nor daily gavage altered the number of marbles buried suggesting no alterations in anxiety-like baselines (FIG. 6).

Conclusions

Chronic treatment with MRX006 did not alter observably anxiety-like behaviour in C57Bl/6 mice in the marble burying test.

Example 1h—Assessing Anxiety-Like Behaviour—the Elevated Plus Maze Test Rationale The elevated plus maze (EPM) is a widely used test to assess anxiety-like behaviours in rodents. The EPM assesses general anxiety behaviour, with less anxious mice spending more time in the open arms of the maze. An increase in open arm activity (duration) reflects anti-anxiety behaviour.

Methods

The set up consisted of a grey plastic cross-shaped maze 1 meter elevated from the floor, comprising two open (aversive) and two closed (safe) arms (50×5×15 cm walls). Experiments occurred under red light (7 lux). Mice were placed into the centre of the maze facing an open arm (to avoid direct entrance into a closed arm) and were allowed to explore the arena for a duration of six minutes. Experiments were videotaped using a ceiling camera to allow for measuring several behavioural parameters. The apparatus was cleaned with 70% (vol/vol) ethanol after each subject to prevent olfactory cues from the previous mouse. Time spent in the open/closed arms, time spent in the center, and the number of transitions were analysed manually. The percentage of time spent and the number of entries in each arm was measured for anxiety-like behaviour and locomotor activity, respectfully. Entrance into an arm was defined as all four paws inside the arm. An increase in open arm activity (duration) reflects anti-anxiety behaviour.

Results

Student t test analysis revealed that daily gavage did not affect the time spent in open arms (FIG. 7). One-way ANOVA analysis revealed that chronic treatment with MRX006 did not alter the behaviour in the elevated plus maze when compared to the control group (FIG. 7). Specifically, chronic treatment with Mrx006 did not alter the time spent in open arms and in closed arms.

Conclusions

Chronic treatment with MRX006 did not observably alter behaviour of C57Bl/6 mice in the elevated plus maze.

Example 1i—Assessing Anxiety Levels in the Stress Induced Hyperthermia (SIH) Test Rationale The SIH paradigm is a well-characterised index of anxiety. In this test, the stress is triggered simply by the measurement of rectal temperature.

Methods

Briefly, animals were singly housed 1 d before the test. Rectal temperature was measured twice with a 15 min interval using a lubricated temperature-sensitive probe. Due to the stress experienced during the first temperature measurement, the temperature of the second measurement (T2) is higher than that of the first (T1). This difference in temperature (ΔT=T2−T1) is defined as the SIH response. The SIH response is reduced by different classes of anxiolytics.

Results

Figure 8:
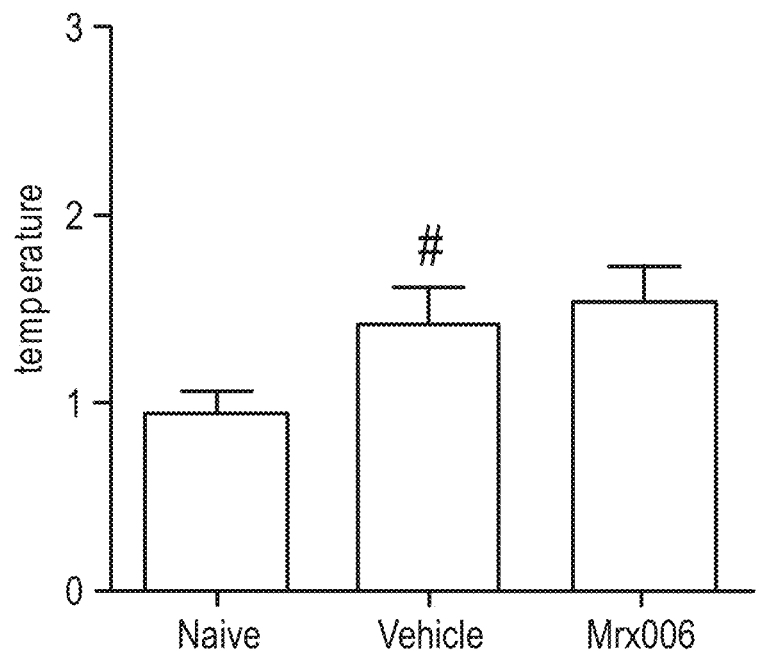
FIG. 8: Effect of treatment with MRX006 on stress induced hyperthermia in C57Bl/6 mice. # Vehicle group significantly different to naïve group, $\#p<0.05$.

Daily handling for gavage increased ΔT suggesting anxiety-like behaviour (Student t test, t (19)=2.121, p=0.047). Chronic treatment with MRX006 did not induce changes in ΔT when compared to the vehicle group (one-way ANOVA, F (2.29)=1.215; p=0.312) (FIG. 8).

Conclusions

Chronic treatment with MRX006 did not observably alter the stress induced change in temperature in the stress induced hyperthermia test in C57Bl/6 mice.

Example 1j—Physiological Analysis—Plasma Oxytocin Levels

Methods and Results

Figure 9:
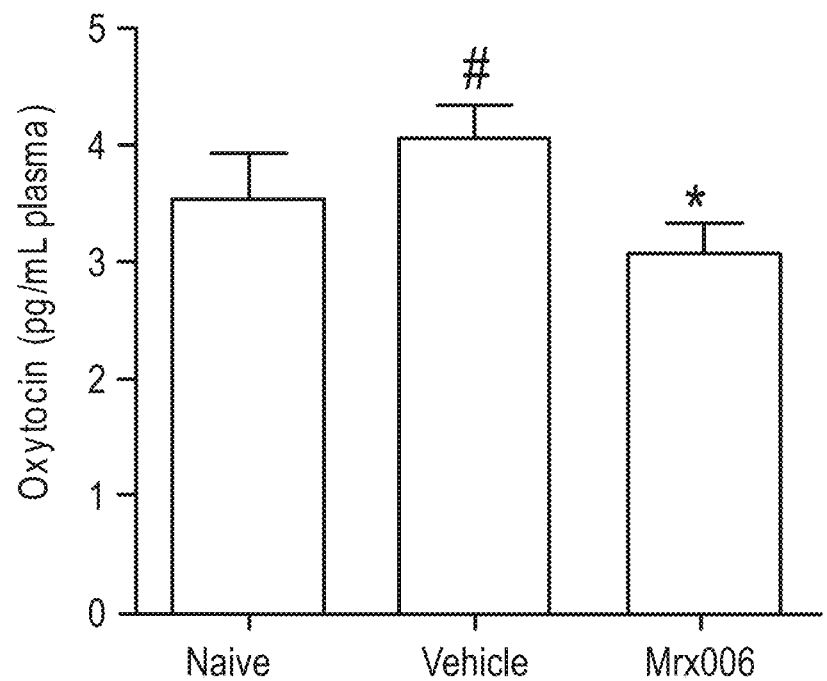
FIG. 9: Effect of treatment with MRX006 on circulating oxytocin levels in C57Bl/6 mice. * Mrx006 significantly different from vehicle group; $*p<0.05$.

Oxytocin levels were measured in naïve, vehicle and MRX006 treated mice (FIG. 9). Oxytocin peptide, which acts in the central nervous systems of males and females is critical for a variety of complex social behaviours including affiliation, sexual behaviour, social recognition, aggression and trust. Radioimmunoassay (RIA) is a sensitive method for measuring very small quantities of peptides and metabolites in the blood. Samples were prepared for RIA and dispatched for oxytocin measure through RIA technique (RIAgnosis, Sinzing, Germany). Chronic treatment with MRX006 in C57Bl/6 mice showed a reduction of oxytocin levels ($p<0.05$).

Example 1 k—Physiological Analysis—Stress-Induced Corticosterone Plasma Levels

Methods and Results

Figure 10A:
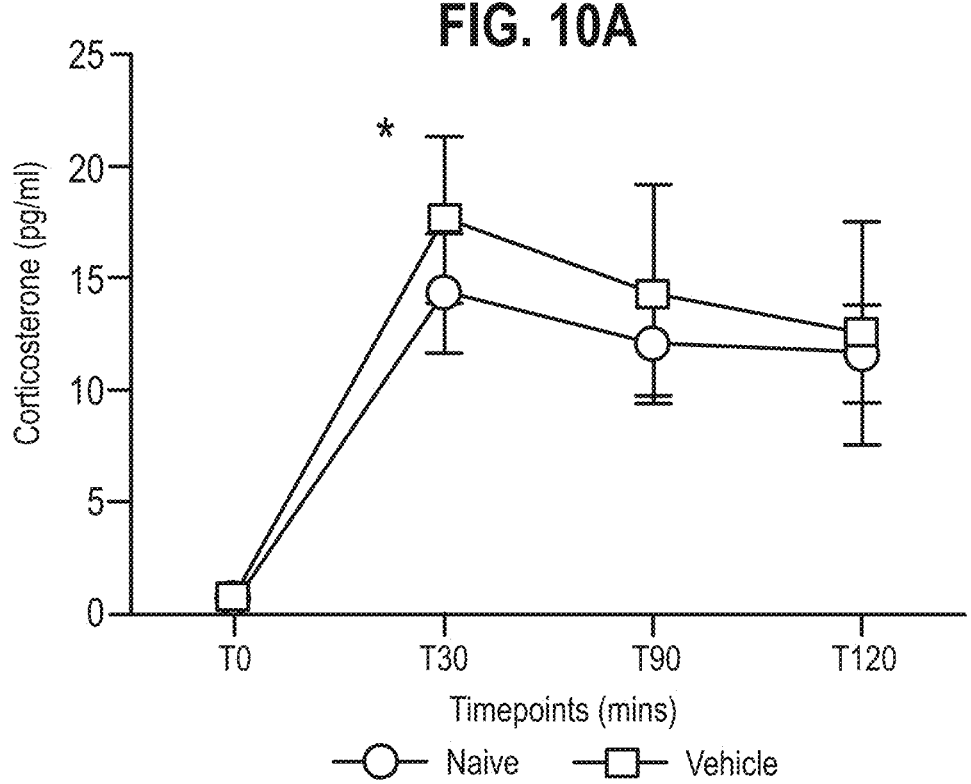
FIGS. 10A-10B: Effect of treatment with MRX006 on corticosterone plasma levels in C57Bl/6 mice. * Significantly different to naïve (FIG. 10A) or vehicle (FIG. 10B) group; $*p<0.05$.
Figure 10B:
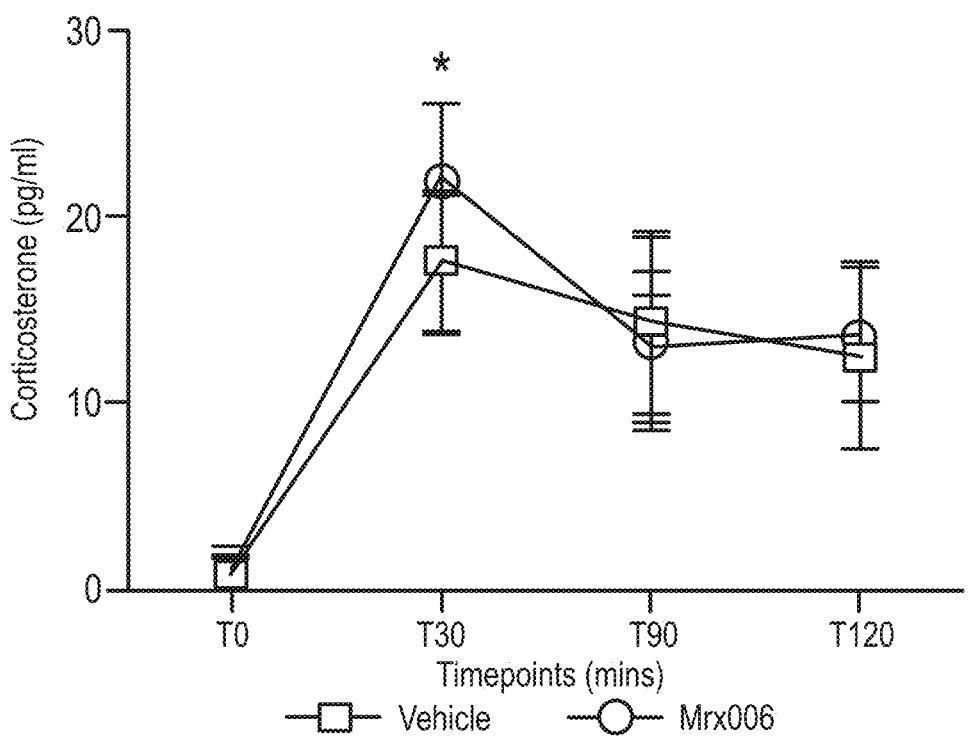

Corticosterone is a major rodent hormone released in response to stress. In this study corticosterone level changes were measured at baseline and following the forced swim test (acute stress exposure) in naïve, vehicle and MRX006-treated mice (FIG. 10). Corticosterone measurements were carried out at different time points, namely at T0 (before forced swim test), and 30 min (T30), 90 min (T90) and 120 min (T120) post-exposure to forced swim test. The data showed a significant increase in stress-induced corticosterone levels in the vehicle group compared to the naïve group at T30 ($p<0.05$). Interestingly, a significant increase in stress-induced corticosterone levels was observed at T30 in MRX006-treated mice when compared to the control group. No significant changes were observed in the other time points. These results may suggest an increased sensitivity to stress in both the vehicle and the MRX006 treated group.

Example 1l—Physiological Analysis—In Vivo Gastrointestinal Permeability Assay

Rationale

This procedure is used to assess in vivo intestinal motility. Gut permeability was quantified between the different chronic treatments through the quantification of Fluorescein isothiocynate (FITC) in the blood post oral administration of the fluorescein derivative. It is an established method to quantify the gut permeability, based on the principal of leaking of the orally administered fluorescein derivative through the gut into the peripheral system.

Methods

Test mice were singly-housed and fasted overnight. The following morning (~9 am), mice were administered FITC dextran ((600 mg/kg) by oral gavage. Two hours later, 100 µl of blood sample was collected in heparin-coated capillary tubes and transferred to a darkened eppendorf and placed on ice. Samples were centrifuged 3500×g for 15 minutes, plasma was aspirated and samples were stored at −80° D for long storage.

Undiluted plasma was used to quantify FITC concentration. 25 µl of FITC was pipetted in duplicated in 384 well plate (Greiner bio one). FITC was measured with a Victor spectrometer between the ranges of 490 nm-520 nm. For a standard curve, a serial dilution of FITC was prepared in PBS (pH7.4). An increase in absorbance is indicative of a decrease in barrier integrity.

Results

The data showed a trend towards an increase in intestine permeability with daily gavages (p=0.051) but it failed to reach significance (FIG. 11). Overall intestine permeability between the MRX006 groups remained unaltered.

Conclusions

Chronic treatment with MRX006 displayed no observable effect on gut permeability.

Example 1m—Physiological Analysis—Organ Weight and Colon Length

Daily handling for gavage and chronic treatment with MRX006 did not induce changes in caecum weight, spleen weight, and adrenal weight (FIG. 12).

Conclusions from the C57Bl/6 Mouse Model

Chronic treatment with MRX006 induced antidepressant-like effects in the forced swim test, a widely used test to screen antidepressant-like activity. In addition, chronic treatment with MRX006 enhanced social behaviour in C57Bl/6 mice, which spend more time interacting with novel versus familiar mice in the 3-chamber test, indicating that MRX006 reversed social impairments, a core symptom of autism spectrum disorders. Furthermore, chronic treatment with MRX006 tended to reduce freezing levels in the fear conditioning test indicating that administration of this strain improves cognitive functions of memory and reduces anxiety in C57Bl/6 mice.

Further studies are required to characterise the effects of MRX006 when acutely or sub-chronically administered on oxytocin levels and corticosterone levels. The evidence indicates that MRX006 modulates signalling of the hypothalamic pituitary axis (HPA).

Therefore, administration of MRX006 causes antidepressant effects, enhances social novelty and pro-cognitive effects.

Example 2—The BTBR Mouse Model

The BTBR mouse model uses inbred, genetically modified mice that display a robust autistic-like phenotype. Deficits in social behaviours, increased repetitive behaviours and increased anxiety-related behaviours have been reported in this strain (Meyza and Blanchard, 2017). Due to this robust behavioural phenotype, the BTBR mouse is an ideal animal model to assess the efficacy of novel therapeutic agents for the treatment of autistic-related behaviours. Alleviation of such symptoms by a live biotherapeutic can also be indicative of efficacy of the biotherapeutic in the treatment of other psychiatric or neurological diseases.

Example 2a—Materials and Methods for BTBR Mouse Model

Mice

Male BTBR mice were bred in house. The animals were housed in a temperature- and humidity-controlled room on a 12 hr dark cycle (lights on from 7:00-19:00 hr). All experiments were conducted in accordance with the European Directive 2010/63/EEC, the requirements of S.I. No 543 of 2012, and approved by the Animal Experimentation Ethics Committee of University College Cork.

Strain

MRX006: *Blautia stercoris* bacterium deposited under accession number NCIMB 42381.

Biotherapeutic was provided in glycerol stock. Live biotherapeutics were grown in the facility in anaerobic conditions.

Live Biotherapeutic Administration

Dosing with MRX006 or vehicle commenced when the mice were 8 weeks old. These mice were treated once daily with MRX006 or phosphate buffer solution (PBS) for 3 weeks before the beginning of the behavioural battery. Mice were further treated once daily during the behavioural battery. MRX006 ($1\times10^7$ to $1\times10^9$ CFU oral administration) was dissolved in PBS prior to administration.

Administration Schedule

The treatment groups for the study are shown below. The vehicle for oral administration is PBS. Daily oral administration occurs via oral gavage.

| Group | Treatment | Number |
|---|---|---|
| 1 | Control (PBS, oral gavage) | 10 |
| 2 | MRX006 (oral gavage in PBS) | 10 |

Fecal Collection

Fresh fecal samples were collected from individual mice every week until the end of the study. At least 20 mg of fresh faeces were placed in a microcentrifuge tube, place immediately on ice and then stored at −80° C.

Experimental Design and Methods

As outlined above, dosing with MRX006 commenced when the mice were 8 weeks old. The initial dosing took place for 3 weeks before the behavioural experiments. The behavioural battery occurred in the following order: marble burying test at week 4; the elevated plus maze at week 5; the open field and novel object recognition tests, and the social transmission of food preference tests at week 6; the female urine sniffing and social interaction tests at week 7, and the forced swimming test at week 9. The carmine red gastrointestinal motility assay and gastrointestinal permeability assay tail bleeds occurred during weeks 8 and 9 respectively. Finally, in weeks 10 to 11, the mice were killed for splenocyte stimulation and ex vivo measurement of FITC in the ileum and colon.

The effects of live biotherapeutic treatment in the BTBR model on stereotyped, social and depression-like behaviours, along with gastrointestinal parameters (permeability and motility) are outlined in the following examples.

Group 1, listed in the table above, represents the control BTBR mice, which would be expected to show phenotypes associated with autistic spectrum disorders. Any effect of treatment on the behavioural symptoms of autistic spectrum disorders would be identified by differences between Group 1 and Group 2.

Graphical Design and Statistical Analysis

All graphs were generated on graphpad prism software (version 5). Data were analysed using IBM SPSS Statistic 22.0 (EEUU). Data distribution was analysed using the Kolmogorov-Smirnov normality test. Data comparing vehicle group versus the MRX006 group were analysed using one-way ANOVA and Fisher's least significant difference (LSD) post hoc test. If ANOVA did not reveal a significant effect of treatment, a priori pairwise comparisons test against the control group was conducted. Non-normally distributed data were analysed by the Kruskal-Wallis and non-parametric Mann-Whitney U test. $P<0.05$ was the criterion for statistical significance.

Example 2b—Assessment of Social Behaviours—the Three Chamber Social Interaction Test Rationale The 3-Chamber Social Interaction Test (3-CSIT) is a well validated ethologically relevant model that assesses social interaction between sex-matched conspecifics and allows for readouts of social novelty and social preference in mice. The test allows mice to freely explore between an inanimate object or sex-matched conspecific mice.

Methods

Animals are placed in a rectangular apparatus divided into three chambers (left and right and a smaller centre chamber) by partitions with small circular openings allowing easy access to all compartments. The test is composed of three sequential 10 min trials: (1) habituation (the test animal is allowed to explore the three empty chambers); (2) sociability (an unfamiliar animal is placed in an inner mesh wire cage in either the left or right chambers); (3) social novelty preference (a novel animal is placed into the previously empty inner cage in the chamber, opposite the now familiar animal). Naive animals should have no preference for either chamber in the habituation phase, a preference for the mouse in the sociability phase, and a preference for the novel mouse in the social novelty phase. An increase in the discrimination ratio would suggest an increase in social behaviour. All animals are age- and sex-matched, with each chamber cleaned and lined with fresh bedding after each 30 minute trial. For each of the three stages, behaviour is recorded by a video camera mounted above the apparatus.

Results

Figure 13A:
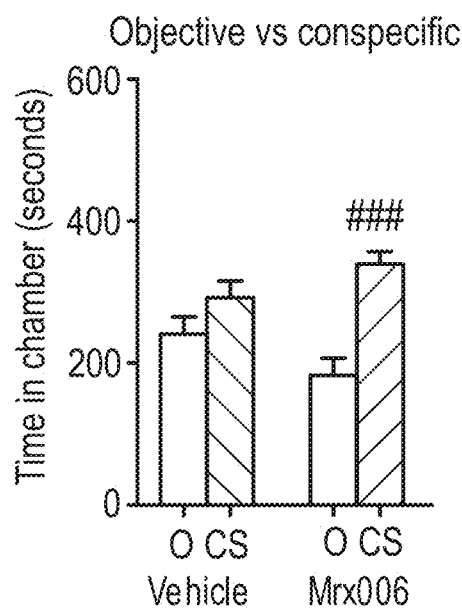
Figure 13B:
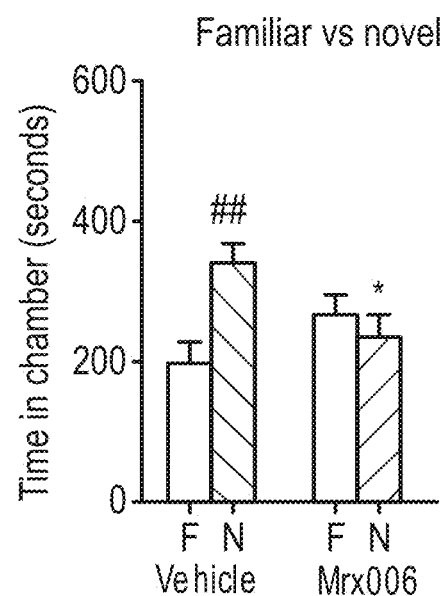
Figure 13C:
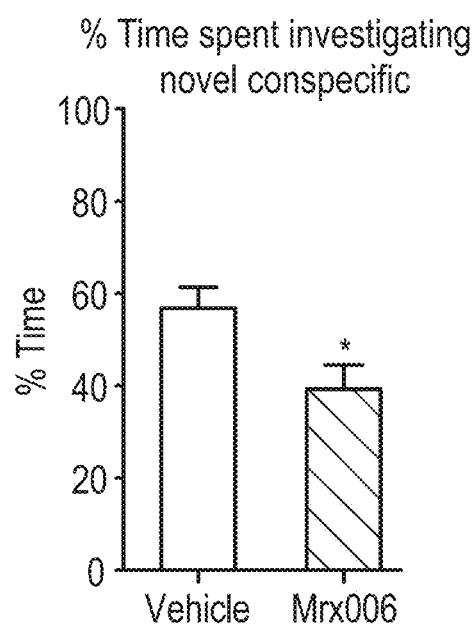

For assessing sociability, student's t-test within groups revealed an increased preference for a novel conspecific (CS) mouse relative to an object for the MRX006 group [$t(22)=5.281$; $P<0.0001$] (FIG. 13A). For assessing social novelty, student's t-test within groups revealed an increased preference for a novel conspecific in the vehicle group only [$t(22)=3.452$; $P<0.001$]. ANOVA of interaction time with the novel conspecific did not reveal an effect of treatment [$F(3,47)=2.492$; $P=0.43$; FIG. 13B]. However, a priori pairwise comparisons test revealed that treatment with MRX006 ($t(22)=0.7497$; $P=0.4614$) decreased interaction time with a novel conspecific when compared to the vehicle group. ANOVA of percentage time spent investigating the novel conspecific revealed an effect of treatment [$F(3,47)=2.942$; $P=0.0433$; FIG. 13C]. Post-hoc comparisons revealed treatment with MRX006 decreased the percentage time investigating a novel conspecific ($p<0.05$).

Two way ANOVA analysis [Object/Conspecific (CS): $F(1,47)=21.164$; $P<0.0001$; Treatment: $F(1,47)=0.56$; $P=0.815$; Object/CS—treatment: $F(1,47)=5.414$; $P=0.025$] followed by post hoc analysis revealed that MRX006 treated mice spent more time investigating the conspecific versus the object (p<0.01; FIG. 13D). Two-way ANOVA analysis [Familiar vs novel: F(1,47)=3.454; P=0.070; Treatment: F(1,47)=0.360; P=0.552; F/N×Treatment: F(1,47)=8.627; P=0.005] followed by post hoc comparisons revealed that mice treated with MRX006 spent significantly less time investigating a novel versus a familiar mouse (p<0.05; FIG. 13E). By contrast, vehicle mice spent more time investigating the novel versus the familiar conspecific (p<0.05; FIG. 13E). Percentage analysis revealed that MRX006 treated mice spent less time interacting with the novel conspecific when compared with the vehicle group (t=2.480 df=22; P=0.0213; FIG. 13F).

Conclusions

Chronic treatment with MRX006 reduces social novelty and decreases social cognition of BTBR mice in the three chamber test.

Example 2c—Assessment of Social Behaviours—Forced Intruder Test

Rationale

This procedure evaluates social interaction behaviour between rodents. By placing an intruder mouse into the resident mouse's home-cage, one can assess social interaction and aggressive behaviour.

Methods

Each session consisted of placing an intruder mouse into a resident mouse's home-cage for a period of 10 minutes. Experiments were videotaped using a ceiling camera to allow for measuring several behavioural parameters. The amount of time that the animals spent interacting was recorded.

Results

Figure 14:
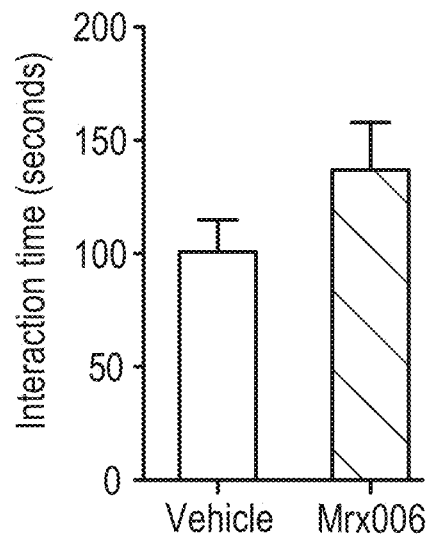
FIG. 14: Effect of treatment with MRX006 on BTBR mice in the forced intruder test.

ANOVA of interaction time did not reveal an effect of treatment [F(3,45)=2.327; P=0.088; FIG. 14]. Similarly, a priori pairwise comparisons test revealed that treatment with MRX006 (t=1.425 df=22; P=0.1682) did not affect social interaction behaviour when compared to the vehicle group.

Conclusions

Chronic treatment with MRX006 does not influence social behaviour of BTBR mic in the social interaction test.

Example 2d—Assessment of Stereotyped Behaviours—the Marble Burying Test

Rationale

This test assesses for repetitive, compulsive and anxious behaviour. A higher number of marbles buried is indicative of greater anxious or stereotyped behaviours. Indeed, Mice treated with pharmacological agents such as anxiolytics show decreased marble burying behaviour, compared to the control mice.

Methods

Mice were individually placed into a novel polypropylene cage (35×28×18.5 cm, L×W×H), containing standard rodent (hard wood) bedding (5 cm) and 20 marbles on top of it (five rows of marbles regularly spaced 2 cm away from the walls and 2 cm apart). Experiments were conducted under a light intensity of 1000 lux. 30 minutes later, mice were removed from these cages and the number of marbles buried for more than ⅔rds of their surface was scored.

Results

Figure 15:
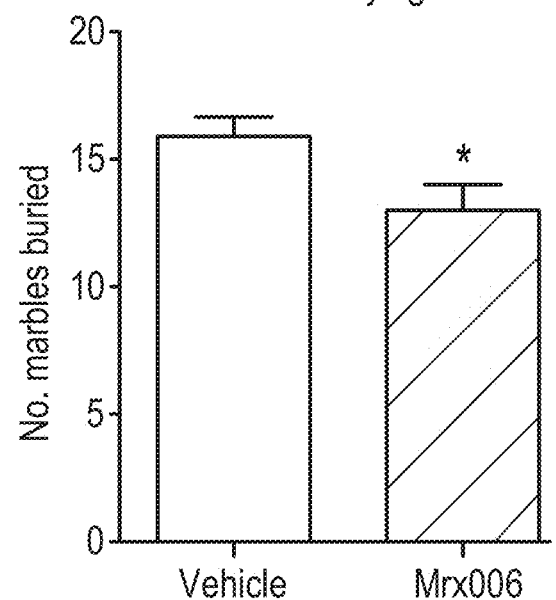
FIG. 15: Effect of treatment with MRX006 on BTBR mice in the marble burying test. $*p<0.05$ relative to vehicle group as determined by a priori comparisons.

There was no effect of treatment as determined by ANOVA on the number of marbles buried [F(3,45)=1.64; P=0.193]. However, a priori pairwise comparisons test revealed that MRX006 (t=2.276 df=21, p<0.05) decreased the number of marbles buried (FIG. 15).

Conclusions

Treatment with MRX006 reduces repetitive behaviour in BTBR mice in the marble burying test.

Example 2e—Assessment of Stereotyped Behaviours—the Grooming Test

Rationale

This test is used as an index for stereotyped and repetitive behaviour. An increase in time spent grooming is indicative of increased stereotyped or repetitive behaviour.

Methods

Mice were individually placed into a novel glass beaker (500 mL), which was covered with a Plexiglas top. Experiments were conducted under a light intensity of 60 lux. Experiments were videotaped using a hand-held camera attached to a tripod stand. Grooming behaviour was recorded for 20 minutes.

Results

Figure 16A:
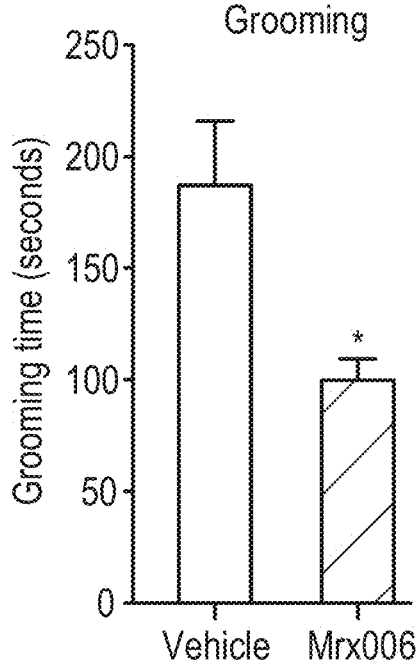
FIGS. 16A-16B: Effect of treatment with MRX006 on BTBR mice in the grooming test. $*p<0.05$ relative to vehicle group. $**p<0.01$ relative to vehicle group as revealed by a priori comparisons.
Figure 16B:
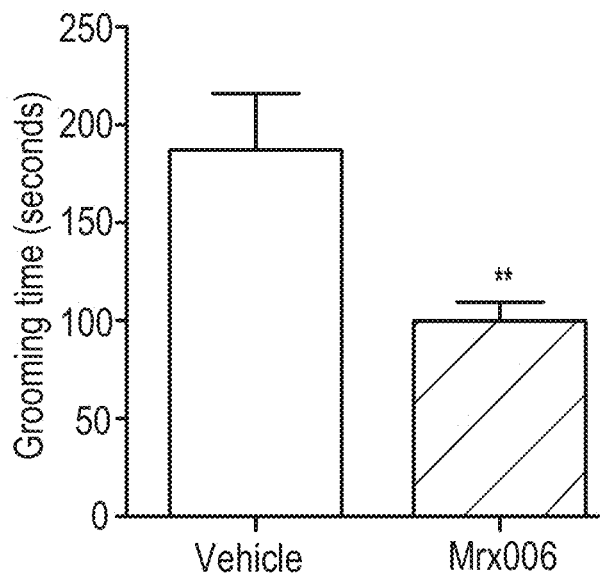

There was a significant effect of live biotherapeutics as determined by ANOVA [F(3,47)=4.174; P=0.011] on grooming activity. Post-hoc comparisons revealed that treatment with MRX006 significantly reduced the amount of time spent grooming relative to the vehicle group (p<0.05) (FIG. 16). Similarly, a priori pairwise comparisons test revealed that MRX006 (t=2.895 df=22, p<0.01) decreased the time spent grooming compared to the vehicle group.

Conclusions

Chronic treatment with MRX006 reduces repetitive behaviours in BTBR mice in the grooming test.

Example 2f—Assessment of Anxiety-Like Behaviours—the Elevated Plus Maze

Rationale

The elevated plus maze (EPM) is a widely used test to assess anxiety-like behaviours in rodents. The EPM assesses general anxiety behaviour, with less anxious mice spending more time in the open arms of the maze. An increase in open arm activity (duration) reflects anti-anxiety behaviour.

Methods

The set up consisted of a grey plastic cross-shaped maze 1 meter elevated from the floor, comprising two open (aversive) and two closed (safe) arms (50×5×15 cm walls). Experiments occurred under red light (7 lux). Mice were placed into the centre of the maze facing an open arm (to avoid direct entrance into a closed arm) and were allowed to explore the arena for a duration of five minutes. Experiments were videotaped using a ceiling camera to allow for measuring several behavioural parameters. The percentage of time spent and the number of entries in each arm was measured for anxiety-like behaviour and locomotor activity, respectfully. Entrance into an arm was defined as all four paws inside the arm.

Results

Figure 17A:
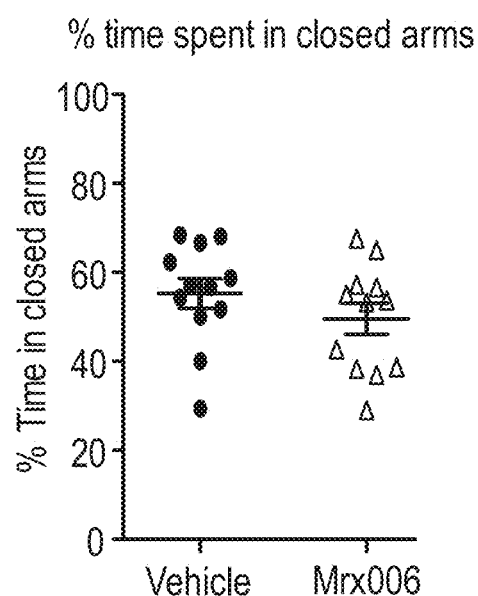
FIGS. 17A-17D: Effect of treatment with MRX006 on BTBR mice in elevated plus maze test.
Figure 17B:
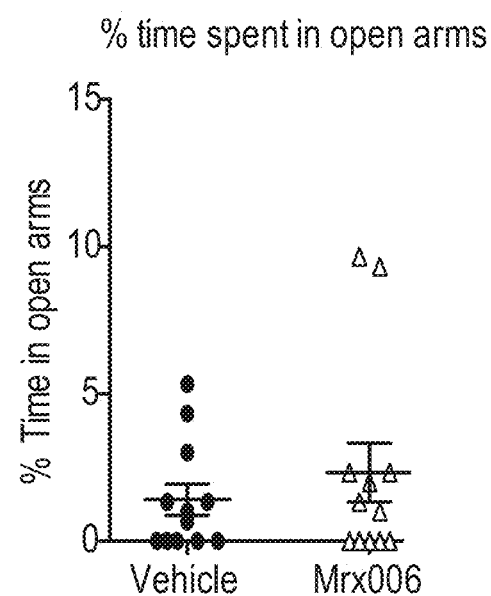
Figure 17C:
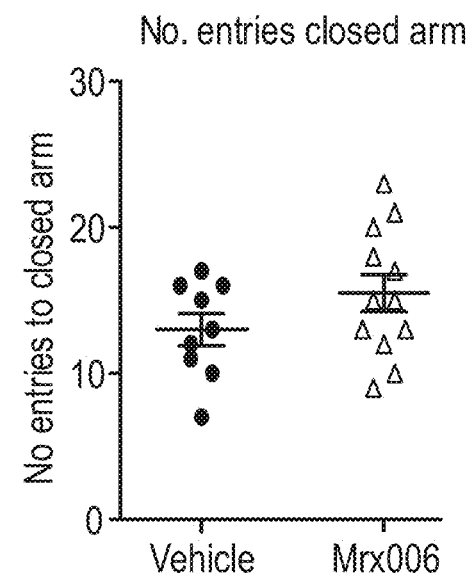
Figure 17D:
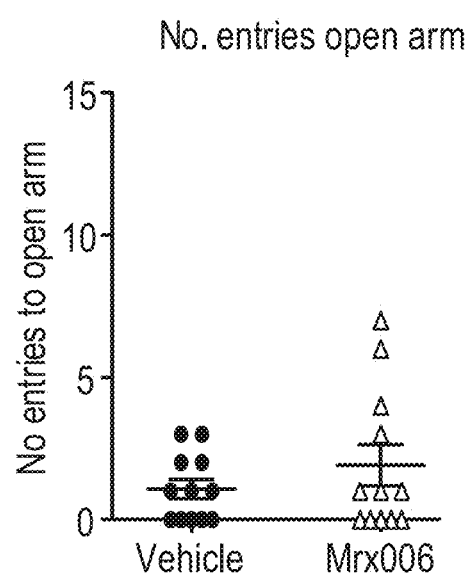

ANOVA analysis revealed no effects of live biotherapeutic treatment on percentage of time spent in closed arms [F(3.47)=0.885; P=0.457; FIG. 17A). Kruskal Wallis non-parametric analysis of percentage time spent in open arms revealed no effect of treatment [chi-squared=1.220; df=3; P=0.748; FIG. 17B]. ANOVA of the number of entries into the closed arms revealed no effect of treatment [F(3, 44)=1.82; P=0.159; FIG. 17C]. Kruskal Wallis non-parametric analysis of number of the entries into the open arms revealed no effect of treatment [chi-squared=2.045; df=3; P=0.563; FIG. 17D].

Conclusions

Chronic treatment with MRX006 has no effect on anxiety-like behaviour in BTBR mice in the elevated plus maze.

Example 2 g—Assessment of Anxiety-Like Behaviours—the Open Field Arena

Rationale

The open field arena is used to assess the response of exposure to a novel stressful environment and locomotor activity. Naïve mice naturally spend most of their time alongside the walls of the arena, as it is less exposed than the centre of the arena. An increase in duration of time spent in the centre represents a decrease in anxiety-like behaviour.

Methods

Mice were individually placed into an open field arena (43×35×25, L×w×h) and allowed to explore for 10 minutes. Experiments occurred under a light intensity of 60 lux. Experiments were videotaped using a ceiling camera to allow for measuring several behavioural parameters using Ethovision software. The distance travelled was scored for locomotor activity.

Results

Figure 18A:
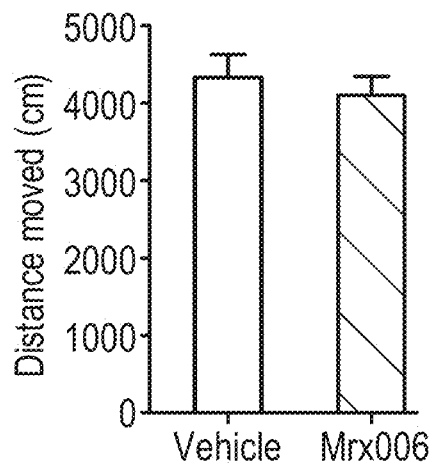
FIGS. 18A-18F: Effect of treatment with MRX006 on BTBR mice in the open field arena. $*p<0.05$ relative to vehicle group.
Figure 18B:
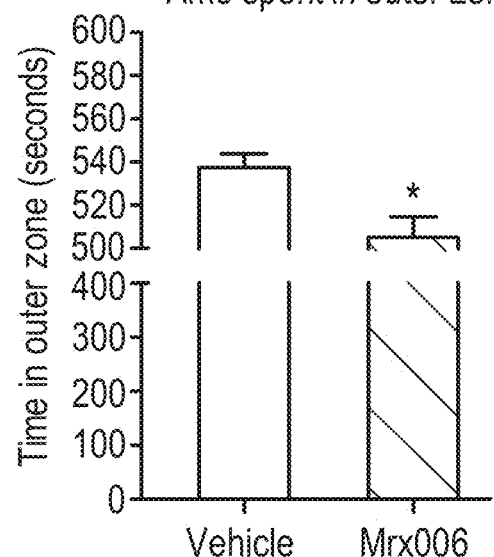
Figure 18C:
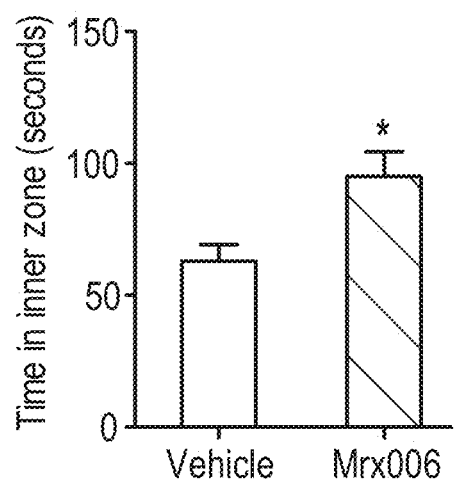
Figure 18D:
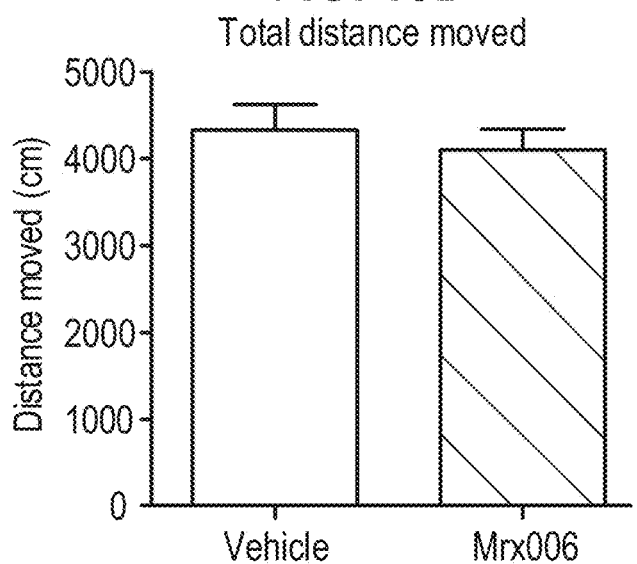
Figure 18E:
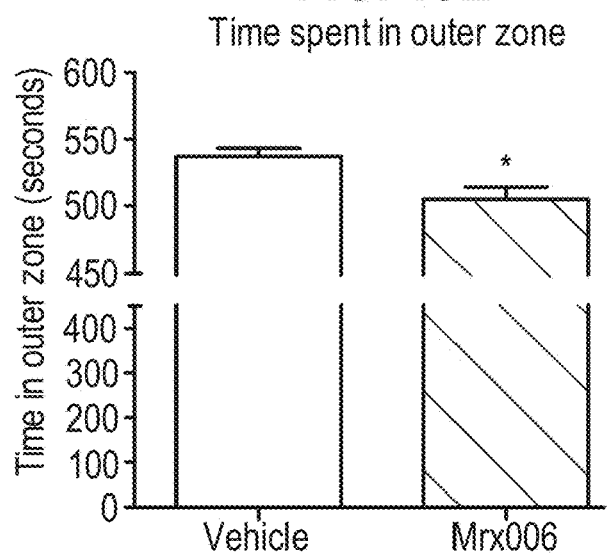
Figure 18F:
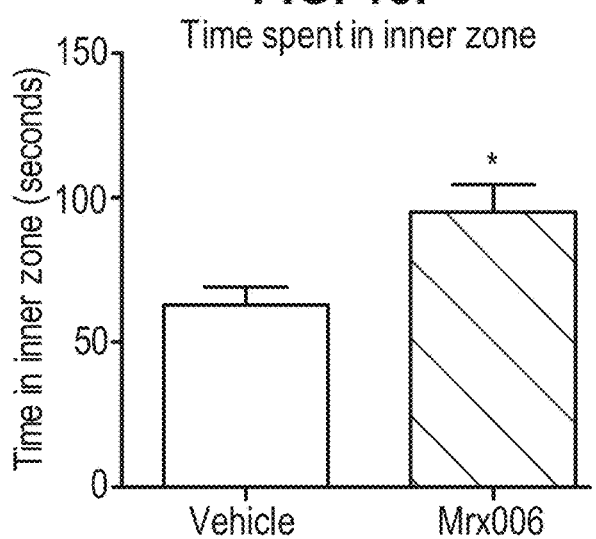

ANOVA of distance moved did not reveal an effect of treatment on locomotor activity in the open field arena [F(3,47)=0.317; P=0.813; FIG. 18A and FIG. 18D]. ANOVA of time spent in the outer zone did not reveal an effect of treatment [F(3,46)=2.217; P=0.100; FIG. 18B]. However, a priori pairwise comparisons test revealed that MRX006 treatment (t=2.791 df=21; p<0.05; FIG. 18E) decreased the time spent in the outer zone of open field arena. ANOVA of time spent in the inner zone did not reveal an effect of treatment [F(3,46)=2.217; P=0.100; FIG. 18C]. However, apriori pairwise comparisons test revealed that MRX006 treatment (t=2.791 df=21; p<0.05; FIG. 18F) increased the time spent in the inner zone of open field arena.

Conclusions

Chronic treatment with MRX006 reduces anxiety-like behaviour in BTBR mice in the open field arena test.

Example 2h—Assessment of Depression-Like Behaviour—the Forced Swim Test

Rationale

The forced swim test (FST) is the most widely used experimental paradigm to assess antidepressant activity. Naïve animals will display escape behaviour in the form of swimming, climbing and diving before adapting an immobile floating posture. The duration of immobility is indicative of behavioural despair. Antidepressant drugs decrease the time spent immobile in this test.

Methods

Mice are forced to swim for 6 min in a glass cylinder (24×21 cm) filled with 23-25° C. tap water to a depth of 17 cm. The FST was videotaped from a ceiling camera. The behavioural parameter scored is immobility during the last 4 min of the 6-min test.

Results

Figure 19:
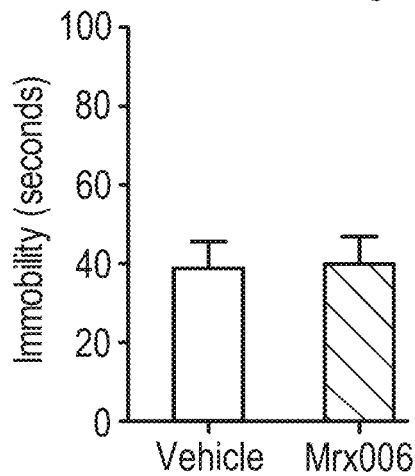
FIG. 19: Effect of treatment with MRX006 on BTBR mice in the forced swim test.

ANOVA of immobility time did not reveal an effect of treatment [F(3,46)=1.309; P=0.284; FIG. 19].

Conclusions

Chronic treatment with MXR006 does not influence immobility time of BTBR mice in the forced swimming test.

Example 2i—Assessment of Depression-Like Behaviour—the Female Urine Sniffing Test Rationale The female urine sniffing test (FUST) is used to assess anhedonic-like behaviour in rodents. A reduction in sniffing time suggests social avoidance/anhedonia while an increase represents an increase in social behaviour/hedonic behaviour.

Methods

Experimental mice are singly housed one week prior to the test. During the test, a cotton tip applicator, dipped in sterile water, is placed into the home cage and mice are allowed to sniff/investigate for three minutes. Following this three minute test, the cotton tip applicator is removed. 45 minutes later, a new cotton tip applicator is dipped into female urine (collected from female mice of the same strain that are in the estrous stage of their cycle), and placed into the cage. Mice are allowed to sniff/investigate this for a further three minutes. The amount of time spent sniffing the water and urine is recorded.

Results

Figure 20A:
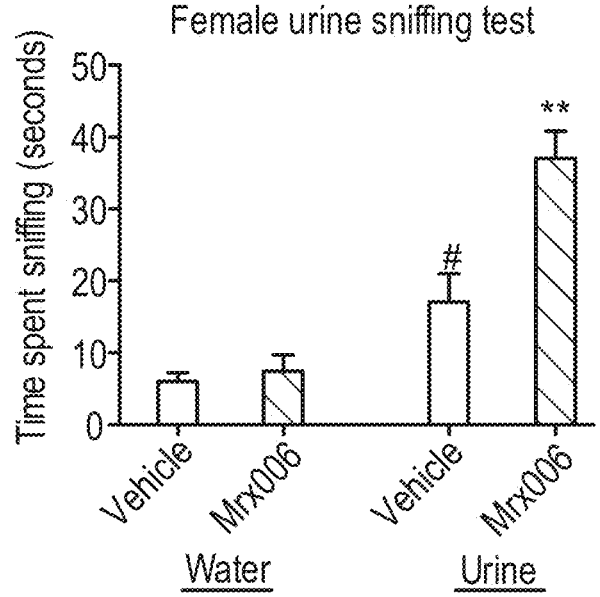
FIGS. 20A-20B: Effect of treatment with MRX006 on BTBR mice in female urine sniffing test. $\#p<0.05$ relative to water vehicle group. $**p<0.01$ relative to vehicle group.

For the vehicle group, student's t-test revealed a significant increase in the time spent sniffing urine relative to the time spent sniffing water [t(16)=2.611; P=0.0189; FIG. 20A]. For exposure to water, ANOVA of time spent sniffing did not reveal an effect of treatment in the water group [F(3,35)=0.875; P=0.464]. For exposure to urine, ANOVA of time spent sniffing did not reveal an effect of treatment [F(3,34)=2.153; P=0.114]. However, a priori comparison revealed that chronic treatment with MRX006 (t=3.602 df=16; P=0.0024) increased the time spent sniffing urine when compared to the vehicle group.

Figure 20B:
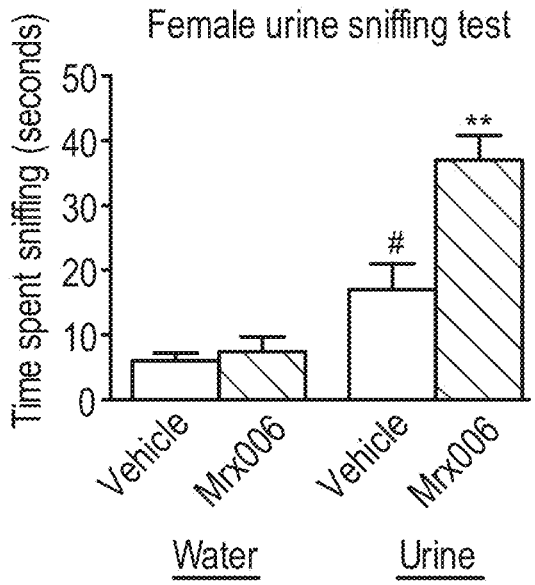

Two-way ANOVA analysis [Urine: [F(1,36)=44.118; P<0.0001]; Treatment: [F(1,36)=12.335; P=0.001]; Urine x treatment: [F(1,36)=9.236; P=0.005] followed by post hoc tests revealed that mice treated with MRX006 spent more time sniffing urine compared with the vehicle group (*p<0.01; FIG. 20B). Importantly, the vehicle mice spent more time sniffing urine than water as expected (#p<0.05).

Conclusions

Chronic treatment with MRX006 significantly increases the time spent sniffing female urine in BTBR mice in the female sniffing urine test.

Example 2j—Assessment of Depression-Like Behaviour—the Novel Object Recognition Test Rationale The protocol used was adapted from Bevins and Besheer (2006), and used to test recognition memory. Improved memory is a reflection of reduced depression-like behaviour.

Methods

The protocol used was adapted from Bevins and Besheer (2006). It was conducted over 3 days. On Day 1, the animals were allowed to acclimate to the testing environment for 10 minutes, which was a large container equipped with an overhead camera. No bedding was used and the container was wiped with 70% ethanol between each animal. On Day 2, the animals were allowed to acclimate to the test apparatus for 10 minutes. Following this period, the animal was removed from the container and two identical objects were introduced to the environment. The animal was returned to the container and allowed to explore for a further 10 minutes. The objects were cleansed before each trial with a 70% ethanol solution. Following the training period, the rodent was removed from the environment for a delay period of 24 hours. On Day 3, the rodent was returned to the container, which this time contained only 1 familiar object from the day previous and 1 novel object. Activity of the animal with the 2 objects was recorded for 5 minutes. The amount of time that the rodent spent exploring each object was recorded by manual observation and a discrimination index (DI) value corresponding to time spent interacting with the novel object over total interaction time was generated. A decrease in DI compared to control rats indicates a deficit in this type of memory.

Results

Figure 21A:
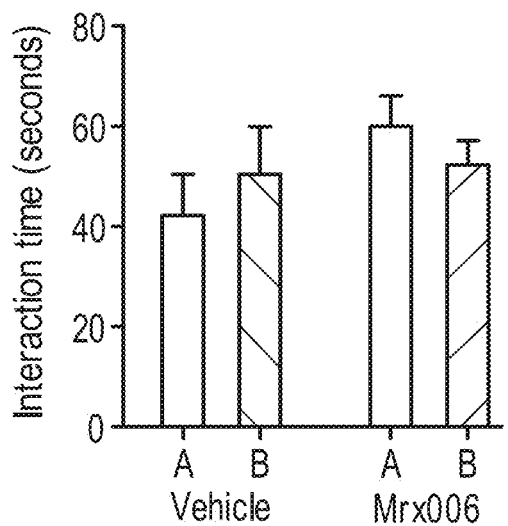
FIGS. 21A-21C: Effect of treatment with MRX006 on BTBR mice in the novel object recognition test.
Figure 21B:
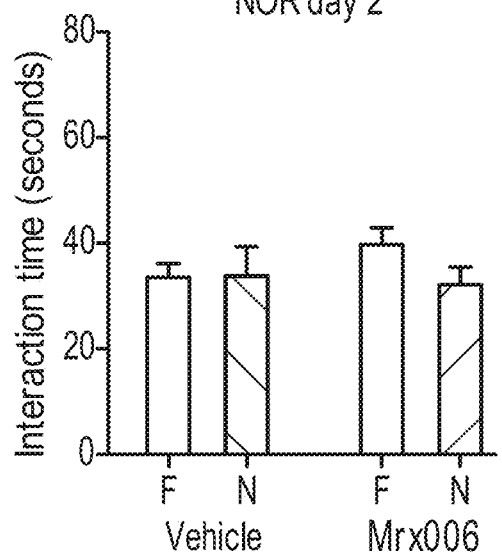
Figure 21C:
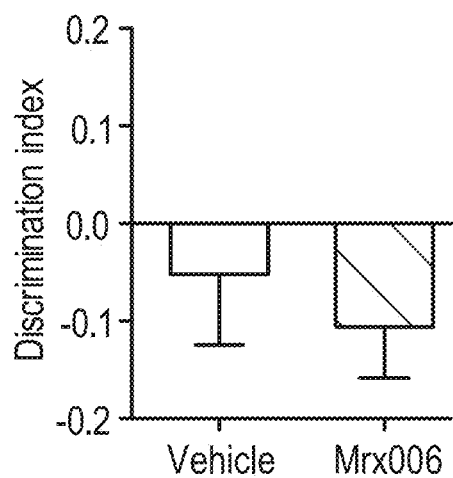

Student t-test within groups did not reveal a side-preference for either object A or B on day one of the novel object recognition test (FIG. 21A). Student t-test within groups did not reveal a preference for the novel object relative to the familiar object. For the novel object, ANOVA of interaction time did not reveal an effect of treatment [$F(3,46)=0.122$; $P=0.946$; FIG. 21B]. In addition, no effect of treatment on discrimination index was revealed by ANOVA analysis [$F(3,47)=0.535$; $P=0.661$; FIG. 21C].

Conclusions

Chronic treatment with MRX006 has no effect on cognitive behaviour in BTBR mice in the novel object recognition test.

Example 2k—In Vivo Gastrointestinal Permeability Assay

Rationale

This procedure is used to assess in vivo intestinal motility.

Methods

Test mice were singly-housed and fasted overnight. The following morning (~9 am), mice were administered FITC dextran ((600 mg/kg) by oral gavage. Two hours later, 100 µl of blood sample was collected in heparin-coated capillary tubes and transferred to a darkened eppendorf and placed on ice. Samples were centrifuged 3500×g for 15 minutes, plasma was aspirated and samples were stored at −80° D for long storage.

Undiluted plasma was used to quantify FITC concentration. 250 of FITC was pipetted in duplicated in 384 well plate (Greiner bio one). FITC was measured with a Victor spectrometer between the ranges of 490 nm-520 nm. For a standard curve, a serial dilution of FITC was prepared in PBS (pH7.4). An increase in absorbance is indicative of a decrease in barrier integrity.

Results

Figure 23:
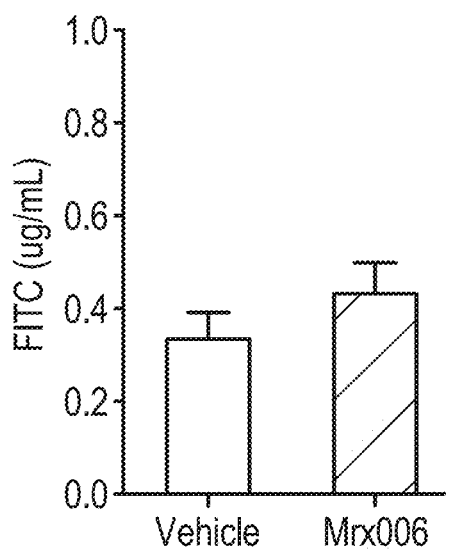
FIG. 23: Effect of treatment with MRX006 on in vivo gastrointestinal permeability in BTBR mice.

Intestinal barrier function was assessed through oral administration of the fluorescent compound, fluorescein isothiocyante (FITC), followed by subsequent tail bleeds to assess levels of FITC in plasma. ANOVA of FITC concentrations did not reveal a significant effect of treatment [$F(3,47)=1.366$; $P=0.266$; FIG. 23].

Conclusion

Chronic treatment with MRX006 did not influence intestinal permeability in BTBR mice.

Example 2l—Ex Vivo Gastrointestinal Permeability Assay

Rationale and Methods

The permeability of the ileum and colon was assessed ex vivo using Ussing chambers. Colon and ileum were excised from mice and collected into 5 mL tubes containing Kreb's buffer. Both colon and ileum were cut along the mesenteric line and mounted onto the Ussing chamber apparatus. For colon, 4 mLs of Krebs solution containing D-glucose were added into both sides of the Ussing chamber apparatus. For ileum, 4 mLs of Krebs solution containing D-mannitol was added into the muscosal side, while an equal volume of Krebs with D-glucose was added to the serosal side. The chambers were oxygenated with carbogen gas (95% O2 and 5% CO2) and kept at 37° C. to maintain tissue integrity. 2.5 mg/mL FITC-dextran was added to the mucosal chamber. Samples were taken from the serosal chamber at timepoints 0 min (baseline), 60 min, 90 min and 120 mins. 25 µl of FITC was pipetted in duplicated in 384 well plate (Greiner bio one). FITC was measured with a Victor spectrometer between the ranges of 490 nm-520 nm. For a standard curve, a serial dilution of FITC was prepared in PBS (pH7.4).

Results

Figure 22A:
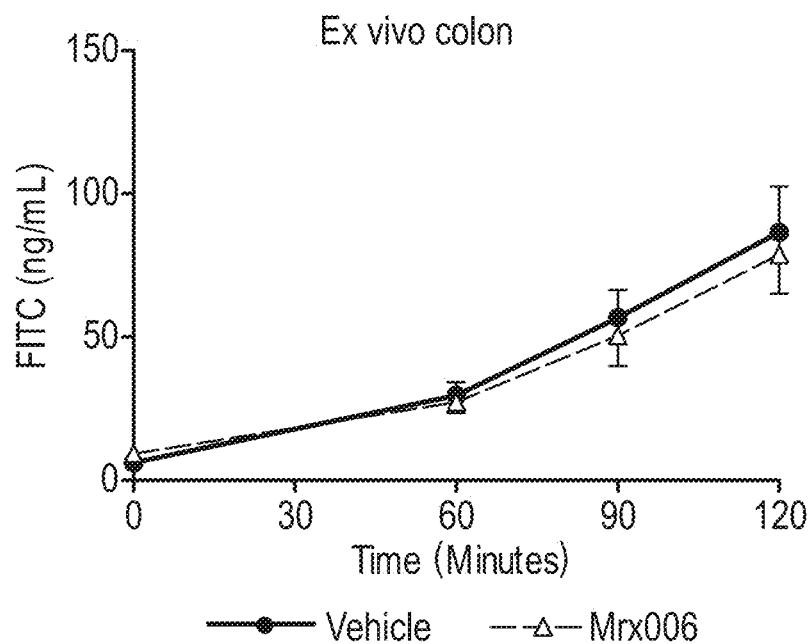
FIGS. 22A-22B: Effect of treatment with MRX006 on ex vivo gastrointestinal permeability in BTBR mice.
Figure 22B:
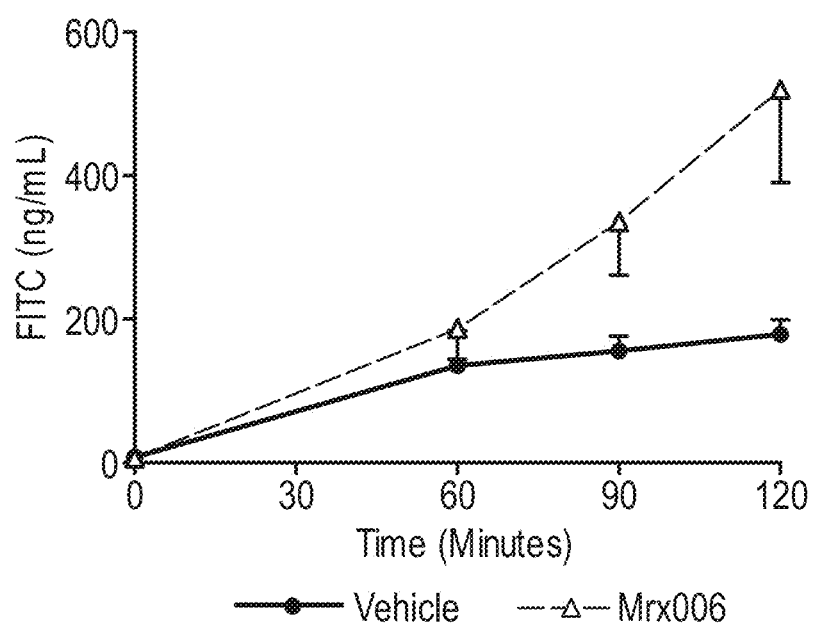

In the ex vivo intestinal permeability assay, repeated measures ANOVA revealed an effect of time for both the colon [$F(3,87)=64.197$; $P<0.0001$] and the ileum [$F(3,87)=34.572$; $P<0.0001$]. Repeated measures ANOVA did not reveal an effect of treatment with respect to time for either the colon [$F(9,87)=1.184$; $P=0.316$; FIG. 23A] or ileum [$F(9,87)=0.810$; $P=0.609$; FIG. 22B].

Conclusions

Chronic treatment with MRX006 does not influence the permeability of the colon or ileum.

Example 2m—In Vivo Gastrointestinal Motility Assay

Rationale

This procedure is used to assess in vivo intestinal motility.

Methods

Mice are singly housed prior to the commencement of the test. Mice were orally gavaged with a non-absorbable, coloured dye (Carmine Red). The time to excretion of the first coloured faecal bolus was recorded and used as an index of peristaltic motility of the whole intestine.

Results

Figure 24:
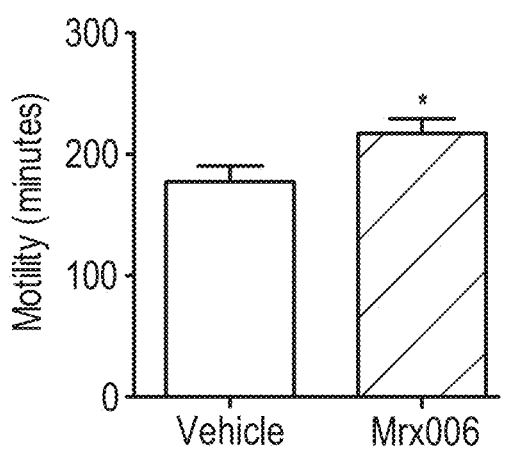
FIG. 24: Effect of treatment with MRX006 on in vivo gastrointestinal motility in BTBR mice. $*p<0.05$ relative to vehicle group as revealed by a priori comparisons.

Mice were administered a non-absorbable, coloured dye (Carmine Red) by oral gavage. The time to excretion of the first coloured faecal bolus was recorded and used as an index of peristaltic motility of the whole intestine. ANOVA of motility time revealed no effect of treatment [$F(3,47)=2.097$; $P=0.114$]. However, a priori pairwise comparisons test revealed that mice treated with MRX006 ($t=2.270$ $df=22$, $p<0.05$; FIG. 24) display altered intestinal motility when compared to the vehicle group.

Conclusions

Chronic treatment with MRX006 showed reduced intestinal motility in BTBR mice.

Example 2n—Stress-Induced Circulating Corticosterone Determination

Rationale

Exposure to the FST results in a robust activation of the HPA axis, with an increase in the levels of the stress hormone, corticosterone. Plasma corticosterone concentrations taken prior to, and after exposure to the FST, were used as an index of stress-induced activation of the hypothalamic pituitary adrenal (HPA) axis.

Methods

On the day of the FST, mice were removed from their home-cage and moved to a surgical room where a basal blood sample was taken. A scalpel blade was used to remove the very tip (1 mm) of the tail. Blood was the collected using a heparinised capillary tube and then transferred to a microcentrifuge tube. Blood samples were also taken 30, 60, 90 and 120 minutes following exposure to the FST to assess for peak and recovery corticosterone levels. Blood was kept on ice and then centrifuged at 2,500×g for 15 minutes at 4° C. Plasma corticosterone was assessed by ELISA, following vendor instructions (ENZO Corticosterone ELISA, ADI-900-097, Enzo Life Sciences).

Results

Figure 25:
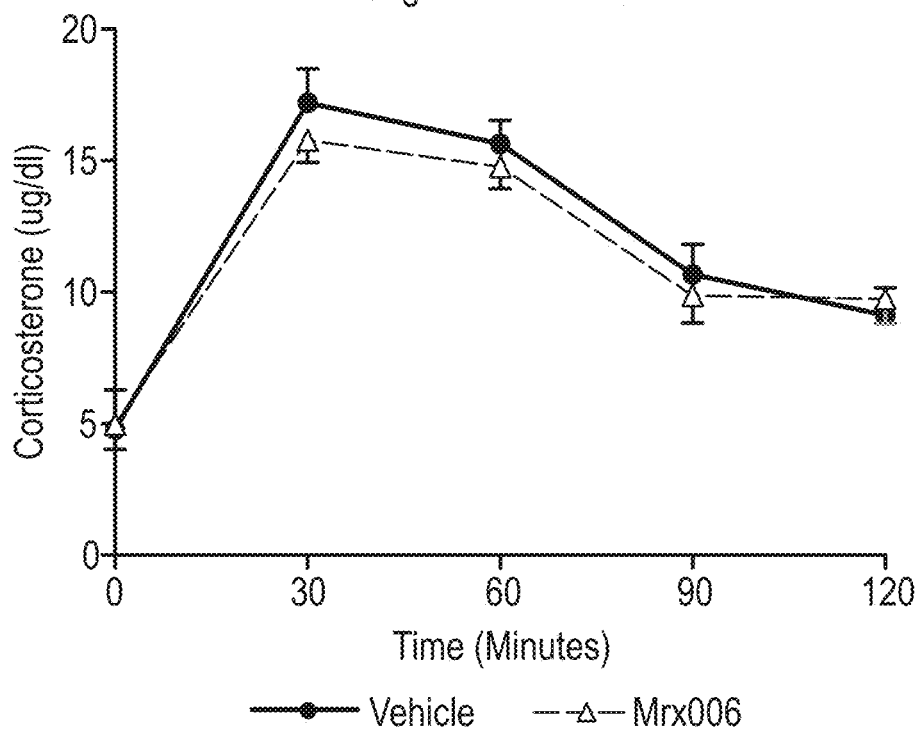
FIG. 25: Effect of treatment with MRX006 on stress-induced corticosterone plasma levels in BTBR mice.

Repeated measures ANOVA revealed a significant effect of time [$F(4,164)=127.127$; $P<0.0001$; FIG. 25]. Post-hoc comparisons revealed a significant increase in circulating corticosterone at the 30-minute time point for all groups. Repeated measures ANOVA did not reveal a significant effect of treatment with respect to time [$F(12,164)=0.561$; $P=0.871$].

Conclusions

Chronic treatment with MRX006 does not influence stress-induced corticosterone levels in BTBR mice exposed to the forced swimming test.

Example 2o—Organ Weight and Colon Length

Figure 26A:
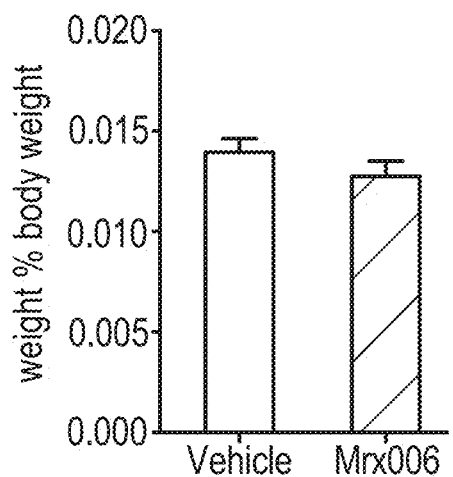
FIGS. 26A-26D: Effect of treatment with MRX006 on organ weight and colon length in BTBR mice.
Figure 26B:
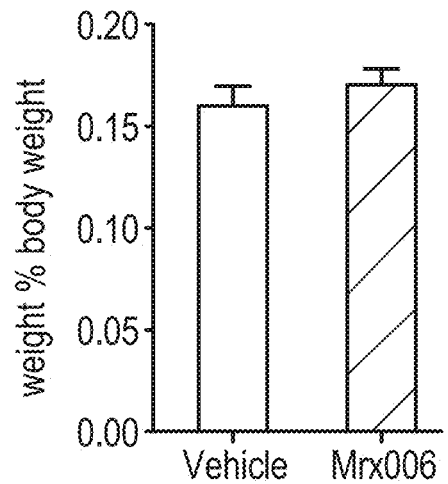
Figure 26C:
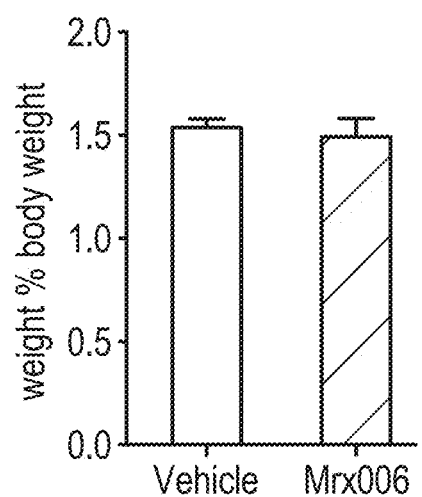
Figure 26D:
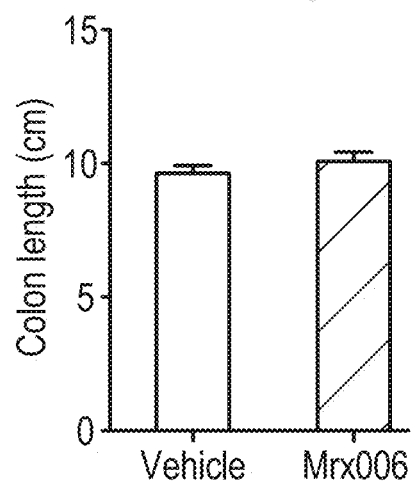

ANOVA of organ weight as a percentage of body weight did not reveal an effect of treatment for the adrenals [$F(3,44)=1.480$; $P=0.234$; FIG. 26A}, spleen [$F(3,43)=0.779$; $P=0.513$; FIG. 26B] or caecum [$F(3,44)=0.441$; $P=0.725$; FIG. 26C]. ANOVA of colon length did not reveal an effect of treatment [$F(3,46)=0.826$; $P=0.487$; FIG. 26D].

Conclusions

Treatment with MRX006 does not influence selective anatomical markers.

Example 2p—Weight Monitoring

Figure 27:
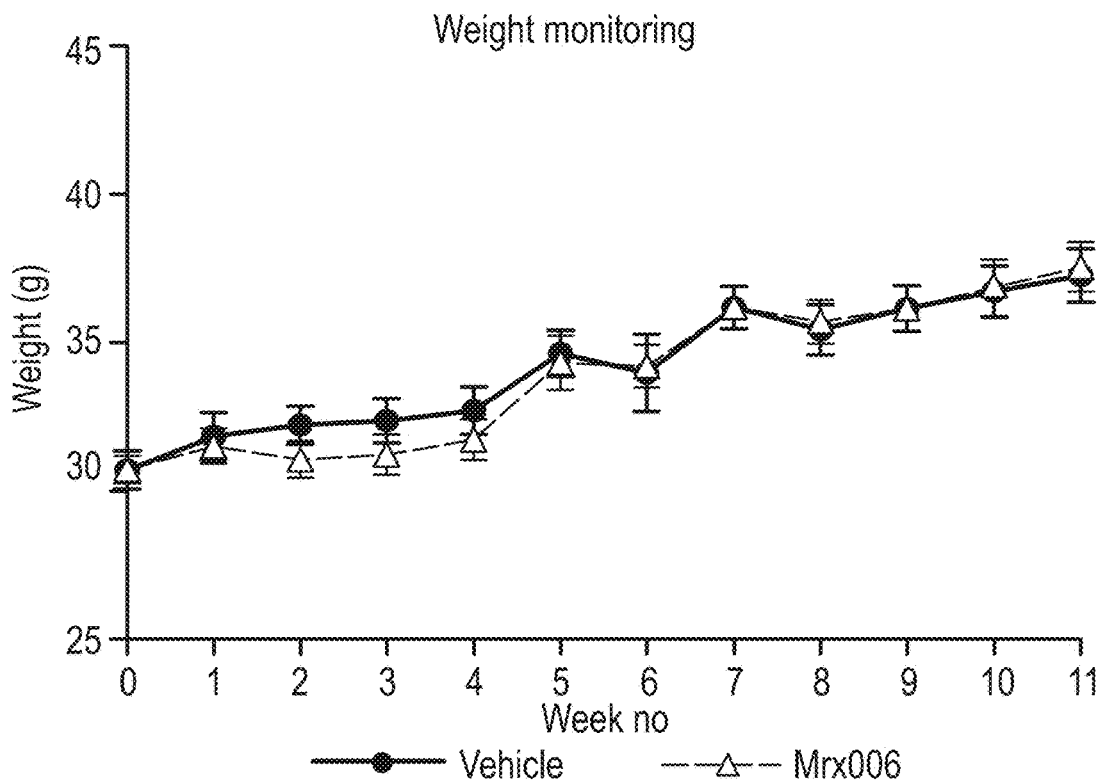
FIG. 27: Effect of treatment with MRX006 on weight of BTBR mice over time.

Animal body weights were assessed once per week over the duration of the experiment to determine whether any of the bacterial strains were influencing this particular parameter. Repeated measures ANOVA revealed a significant effect of time [$F(11,484)=111.217$; $P<0.0001$; FIG. 27]. Repeated measures ANOVA did not reveal an effect of treatment with respect to time [$F(33,484)=0.581$; $P=0.971$].

Conclusions

Chronic treatment with MRX006 does not influence body weight in BTBR mice.

Conclusions from the BTBR Mouse Model

The main findings of this study were that treatment with MRX006 attenuated stereotyped and anxiety-related behaviours. Specifically, MRX006 reduced the number of marbles buried in the marble burying test as well as reducing the amount of time that animals spent grooming. Moreover, treatment with this live biotherapeutic increased the amount of time spent in the centre of the open field, corresponding with a decrease in the amount of time spent in the periphery, which is indicative of an anxiolytic-like effect. However, no effects on anxiety-like behaviour were observed in the elevated plus maze test. The ability of MRX006 to improve stereotyped and anxiety related behaviours in BTBR mice is promising and indicates that it may be an effective therapeutic.

MRX006 also increased the time spent sniffing urine from female mice. The female urine sniffing test was originally designed as a test to assess hedonic-like behaviour in rodents, with increases in the time spent sniffing urine interpreted as an increase in reward seeking behaviour (Malkesman et al., 2010). Given that BTBR mice are not reported to display a depressive-like phenotype, it is unlikely that the observed increase in time spent sniffing urine in the current experiments following treatment with MRX006 reflects an improvement in hedonic behaviour. Rather, it may be that MRX006 is increasing the ability of these mice to recognise and process social information (i.e. female pheromones). However, no differences in social behaviour among the groups were observed in the 3 chamber test and social interaction test. Treatment with MRX006 reduced the amount of time that mice spent investigating a novel conspecific mouse relative to a familiar conspecific.

With the exception of intestinal motility, the live biotherapeutic assessed in the current study did not affect the several physiological parameters measured. For instance, no effect of the live biotherapeutic was observed in stress-induced corticosterone secretion, anatomical weight, intestinal permeability or total body weight. In the intestinal motility assay, treatment with MRX006 prolonged the time taken for the first red pellet to appear following oral gavage with carmine red dye. Such results suggest that MRX006 prolongs intestinal motility.

Example 3—The Maternal Immune Activation (MIA) Mouse Model

The MIA mouse model uses an environmental immune challenge in pregnant mice in order to trigger the core symptoms of autism spectrum disorder in the offspring. MIA mice typically display stereotyped behaviour (as shown by the grooming and marble burying tests) and deficits in social communication (as shown by the social play, 3-chamber social interaction, and social transmission of food preference tests). The offspring display the three core symptoms of autism (reduced communication; reduced sociability; and increased repetitive or stereotyped behaviour) and therefore provide a suitable model in which to determine whether administration of a therapeutic can alleviate the behavioural phenotypes associated with autistic spectrum disorders and indeed in a number of other neurological disorders. It is well established that alteration of behavioural phenotypes in animal models is indicative of a potentially clinically relevant intervention, irrespective of an understanding of the underlying biological or physiological mechanism (Crawley 2012).

Example 3a—Materials and Methods for MIA Mouse Model

Mice

Maternal immune activation (environmental ASD mouse model) protocol was conducted as previously described (Hsiao, McBride et al. 2013). Briefly, pregnant C57BL/6N mice (ENVIGO, UK) were injected i.p. on E12.5 with saline or 20 mg/kg poly(I:C) according to methods described in (Hsiao, McBride et al. 2013). These mice are listed in the experiments below as MIA mice. Male mice started behaviour at 8 weeks old. The animals were housed in a temperature- and humidity-controlled room on a 12 hr dark cycle (lights on from 7:00-19:00 hr). All experiments were conducted in accordance with the European Directive 2010/63/EEC, the requirements of S.I. No 543 of 2012, and approved by the Animal Experimentation Ethics Committee of University College Cork.

Strain

MRX006: *Blautia stercoris* bacterium deposited under accession number NCIMB 42381.

Live biotherapeutics were grown in the facility in anaerobic conditions.

Live Biotherapeutic Administration

Dosing with MRX006 or vehicle commenced when the mice were 8 weeks old. These mice were treated once daily with MRX006 or phosphate buffer solution (PBS) for 3 weeks before the beginning of the behavioural battery. Mice were further treated once daily for 5 weeks during the behavioural battery. MRX006 ($1 \times 10^7$ to $1 \times 10^9$ CFU oral administration) was dissolved in PBS prior to administration.

Administration Schedule

The treatment groups for the study are shown below. The vehicle for oral administration is PBS. Daily oral administration occurs via oral gavage.

| Group | Treatment | Number |
|---|---|---|
| 1 | Control (PBS, oral gavage) | 9 |
| 2 | Vehicle MIA (PBS, oral gavage) | 15 |
| 3 | MRX006 MIA (oral gavage in PBS) | 13 |

Fecal Collection

Fresh fecal samples were collected from individual mice every week until the end of the study. At least 20 mg of fresh faeces were placed in a microcentrifuge tube, place immediately on ice and then stored at $-80°$ C.

Experimental Design and Methods

As outlined above, dosing with MRX006 or vehicle commenced when the mice were 8 weeks old. The behavioural battery occurred in the following order: the open field arena at week 4, the marble burying test at week 5; social transmission of food preference test at week 6, and the female urine sniffing test at week 7. The carmine red gastrointestinal motility assay and gastrointestinal permeability assay tail bleeds occurred during weeks 7 and 8 respectively. Finally, in week 9, the mice were killed for splenocyte stimulation and ex vivo measurement of FITC in the ileum and colon.

The effects of live biotherapeutic treatment in the MIA model on stereotyped, social and depression-like behaviours, along with gastrointestinal parameters (permeability and motility) are outlined in the following examples.

Group 2, listed in the table above, represents the maternal immune activation mice, the mothers of which were treated with poly (I:C) during pregnancy. These mice would be expected to show phenotypes associated with autistic spectrum disorders compared to the control mice (Group 1)—this control ensures that the poly (I:C) administration did cause the expected behavioural symptoms in the maternal mouse offspring. Any effect of treatment on the behavioural symptoms of autistic spectrum disorders would be identified by differences between Group 2 and Group 3.

Graphical Design and Statistical Analysis

All graphs were generated on graphpad prism software (version 5). Data were analysed using IBM SPSS Statistic 22.0 (EEUU). Data distribution was analysed using the Kolmogorov-Smirnov normality test. Data comparing vehicle group versus the MRX006 group were analysed using one-way ANOVA and Fisher's least significant difference (LSD) post hoc test. If ANOVA did not reveal a significant effect of treatment, a priori pairwise comparisons test against the control group was conducted. Non-normally distributed data were analysed by the Kruskal-Wallis and non-parametric Mann-Whitney U test. $P<0.05$ was the criterion for statistical significance.

Example 3b—Assessment of Stereotyped Behaviours—the Marble Burying Test

Rationale

This test assesses for repetitive, compulsive and anxious behaviour. A higher number of marbles buried is indicative of greater anxious or stereotyped behaviours. Indeed, Mice treated with pharmacological agents such as anxiolytics show decreased marble burying behaviour, compared to the control mice.

Methods

Mice were individually placed into a novel polypropylene cage ($35 \times 28 \times 18.5$ cm, L×W×H), containing standard rodent (hard wood) bedding (5 cm) and 20 marbles on top of it (five rows of marbles regularly spaced 2 cm away from the walls and 2 cm apart). Experiments were conducted under a light intensity of 1000 lux. 30 minutes later, mice were removed from these cages and the number of marbles buried for more than ⅔rds of their surface was scored.

Results

Figure 28:
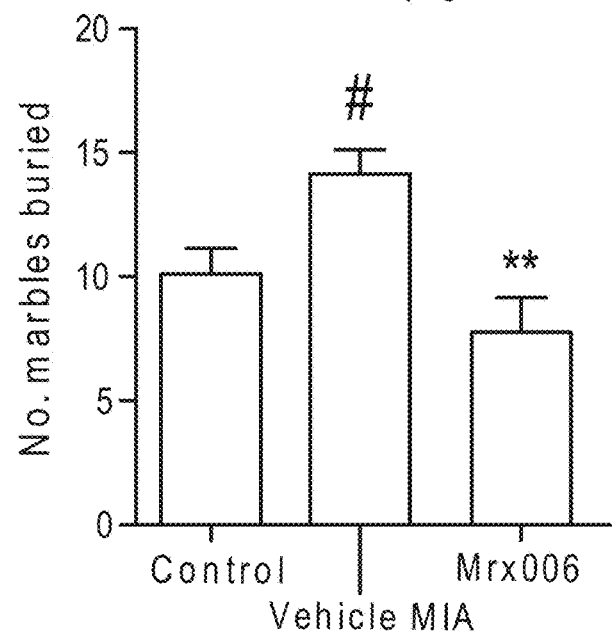
FIG. 28: Chronic treatment with Mrx006 decreased the number of marbles buried in a MIA mice model. $\#p<0.05$ relative to control group; $**p<0.01$ relative to vehicle MIA group.

Student's t-test analysis between the control group and the vehicle MIA group revealed that the vehicle MIA mice buried more marbles compared to the control group ($t(21)=2.751$, $P=0.011$; FIG. 28). ANOVA of the number of marbles buried revealed a significant effect of treatment [$F(3,48)=18.39$; $P<0.001$]. Post-hoc comparisons revealed that chronic treatment with MRX006 decreased the number of marbles buried ($p<0.01$; FIG. 28).

Conclusions

The vehicle MIA group showed significantly more marbled buried than the control group, indicating that the MIA model successfully triggered autistic spectrum disorder-like symptoms in the mice. Chronic treatment with MRX006 reduces repetitive, compulsive and anxious behaviour in MIA mice.

Example 3c—Assessment of Social Behaviours—Social Transmission of Food Preference Rationale Social transmission food preference is a relevant test of olfactory memory that is used in mice to assess social behaviour. In this test, observer mice interact with a demonstrator mouse that has recently eaten novel food. When observer mice are presented with a choice between the food eaten by the demonstrator and some other novel food, observer mice should prefer the food eaten by the demonstrator. Reduced food preference would indicate reduced sociability.

Methods

This test was performed as previously described (Desbonnet, Clarke et al. 2015). Briefly, 18 hours prior to testing, mice were deprived of food, whereas water was available ad libitum. Food choices consisted of either 1% ground cinnamon or 2% powdered cocoa made with grounded mouse chow. A demonstrator mouse was randomly selected from each cage and the tail was marked using a blue marker to enable identification during subsequent social interactions. Demonstrator food containers were weighed before and after the 1 hour sampling sessions. A minimum of 0.2 g of consumed food was required for inclusion in the test. Demonstrator mice were placed back into their respective home cages for a 30 minute interaction period with cage-mates. Subsequently, cage-mates were individually tested for preference of cued food or novel food. Containers were weighed immediately before and after each choice session.

Observed mice were then placed back into their respective home cages and the choice session was repeated 24 hours later. The test mice should smell the cinnamon or cocoa off the demonstrator mouse as a social cue, and preferentially choose the same food when given a choice between the two.

Results

Figure 29A:
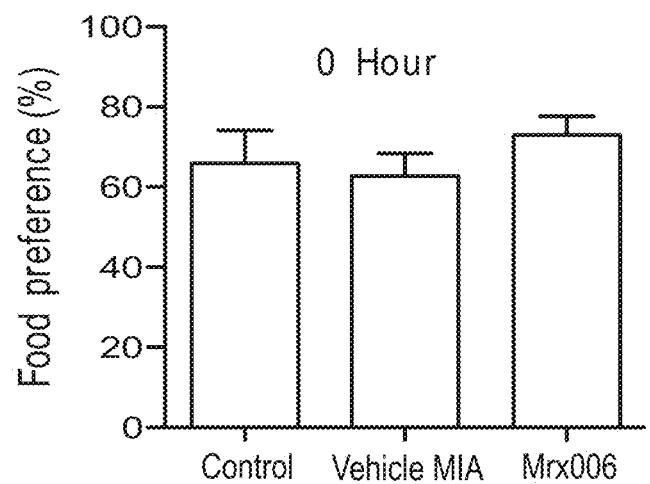
FIGS. 29A-29B: Effect of chronic treatment with MRX006 on sociability in MIA mice in the social transmission of food preference test.
Figure 29B:
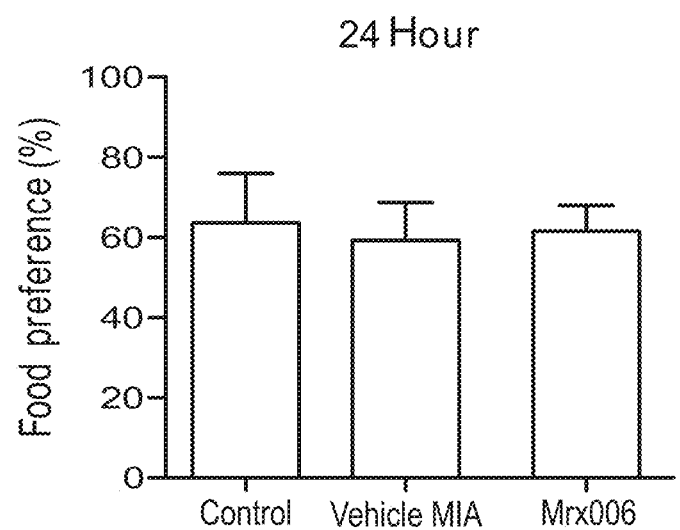

Student's t-test of percentage food preference revealed no difference between control and vehicle MIA groups at either the 0 hour (t(22)=0.3325, P=0.7427) or 24 hour (t(21)=0.2878, P=0.7763) assessment. ANOVA of demonstrator cued food preference revealed no significant difference when observers were exposed to food choice at the 0 hour [F(3,48)=1.49, P=0.228; FIG. 29A] or 24 hour assessment [F(3,47)=2.66, P=0.059; FIG. 29B]. Treatment with MRX006 did not alter preference for cued food in the social transmission of food preference test.

Conclusions

The vehicle MIA group did not display reduced social transmission food preference (the MIA vehicle displayed no alteration in food preference compared to the control), suggesting the MIA model has not triggered the reduced sociability phenotype. Chronic treatment with MRX006 had not effect on food preference. However, as the MIA model appears not to have caused a reduced sociability phenotype in this test, it is not possible to determine the effects of chronic treatment with MRX006 on sociability in the social transmission of food preference test.

Example 3d—Assessment of Anxiety-Like Behaviour—the Open Field Arena

Rationale

The open field arena is used to assess the response of exposure to a novel stressful environment and locomotor activity. Naïve mice naturally spend most of their time alongside the walls of the arena, as it is less exposed than the centre of the arena. An increase in duration of time spent in the centre represents a decrease in anxiety-like behaviour.

Methods

Mice were individually placed into an open field arena (43×35×25, L×w×h) and allowed to explore for 10 minutes. Experiments occurred under a light intensity of 60 lux. Experiments were videotaped using a ceiling camera to allow for measuring several behavioural parameters using Ethovision software. The distance travelled was scored for locomotor activity.

Results

Student's t-test revealed no significant difference in the total distance moved between control and vehicle MIA groups (t(22)=0.9357, P=0.3596). ANOVA of total distance moved revealed a significant effect of treatment [F(3,47)=4.36, P=0.003, FIG. 30A]. Post hoc comparisons revealed that treatment with MRX006 reduced total distance travelled relative to vehicle treated animals (p<0.05). Student's t-test revealed a significant increase in the time spent in the outer zone of the open field by the vehicle MIA group relative to the control group (t(21)=3.337, P=0.003). ANOVA of time spent in the outer zone of the open field revealed no effect of treatment [F(3,47)=0.093, FIG. 30B]. Student's t-test revealed a significant decrease in the time spent in the inner zone by the vehicle MIA groups relative to the control mice (t(21)=3.337, P=0.003). ANOVA of time spent in the inner zone revealed no effect of treatment [F(3,47)=0.93, P=0.96, FIG. 30C].

Conclusions

Treatment with MRX006 decreases the distance travelled by MIA mice in the open field arena. Therefore, MRX006 may be attenuating stress-induced locomotor activity caused by exposure to the open field arena.

Example 3e—Assessment of Depression-Like Behaviour—the Female Urine Sniffing Test Rationale The female urine sniffing test (FUST) is used to assess anhedonic-like behaviour in rodents. A reduction in sniffing time suggests social avoidance/anhedonia while an increase represents an increase in social behaviour/hedonic behaviour.

Methods

Experimental mice are singly housed one week prior to the test. During the test, a cotton tip applicator, dipped in sterile water, is placed into the home cage and mice are allowed to sniff/investigate for three minutes. Following this three minute test, the cotton tip applicator is removed. 45 minutes later, a new cotton tip applicator is dipped into female urine (collected from female mice of the same strain that are in the estrous stage of their cycle), and placed into the cage. Mice are allowed to sniff/investigate this for a further three minutes. The amount of time spent sniffing the water and urine is recorded.

Results

Figure 31:
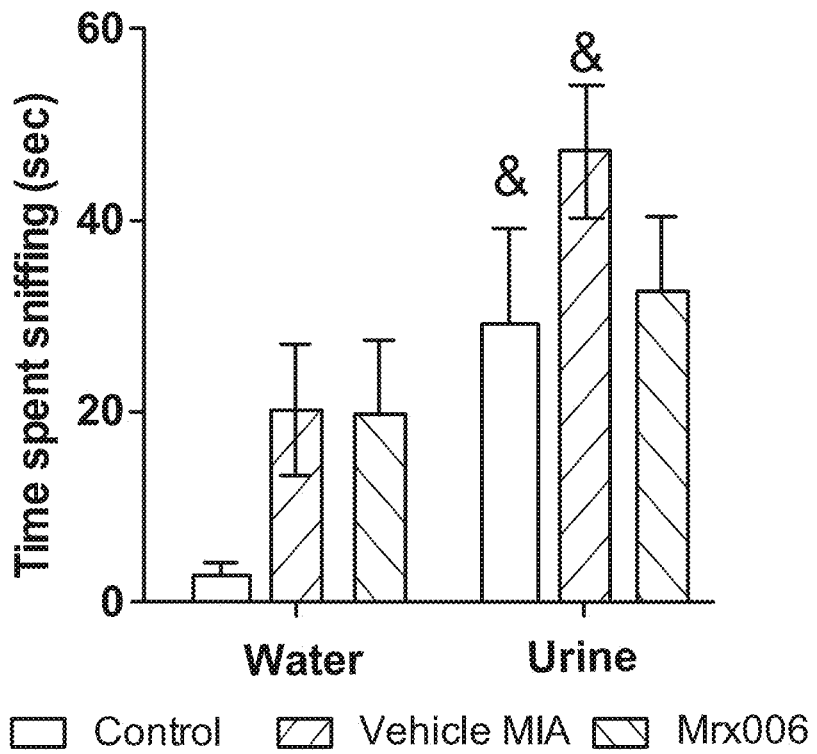
FIG. 31: Effect of chronic treatment with MRX006 on depressive-like behaviour in MIA mice in the female urine sniffing test. & $p<0.05$ relative to respective water group.

Mann-Whitney U-test revealed that both control [Mann-Whitney U value=7, P=0.0123] and vehicle MIA [Mann Whitney U value=57; P=0.0201] groups spent more time sniffing urine than water (FIG. 31). For time spent sniffing urine, Kruskal-Wallis non-parametric analysis did not reveal an effect of treatment [df=4, P=0.3293].

Conclusions

Chronic treatment with MRX006 does not influence depressive-like behaviour in MIA mice in the female sniffing urine test.

Example 3f—In Vivo Intestinal Motility Assay

Rationale

The MIA model has been reported to lead to changes in gut barrier function. Therefore, it was important to ascertain whether chronic treatment with the biotherapeutic alters intestinal motility.

Methods

Mice are singly housed prior to the commencement of the test. Mice were orally gavaged with a non-absorbable, coloured dye (Carmine Red). The time to excretion of the first coloured faecal bolus was recorded and used as an index of peristaltic motility of the whole intestine.

Results

Figure 32:
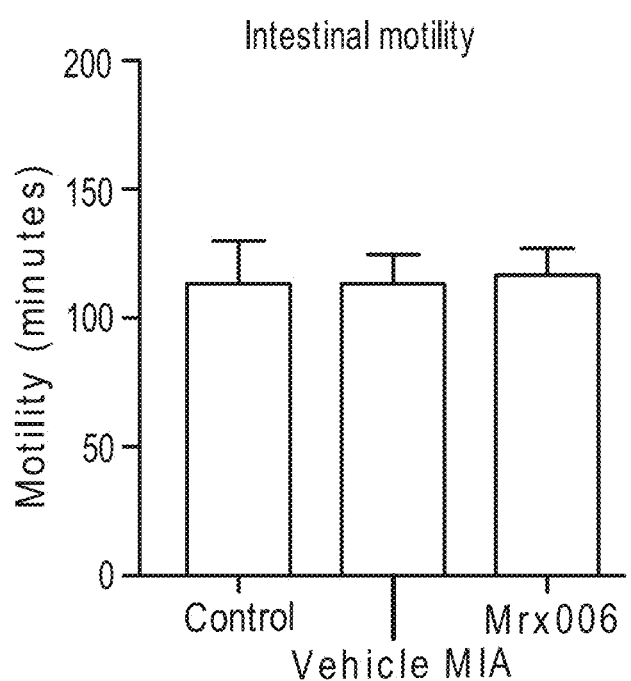
FIG. 32: Effect of treatment with MRX006 on in vivo gastrointestinal motility in MIA mice.

Student's t-test analysis revealed that vehicle MIA group do not exhibit altered intestinal motility (red pellet detected in less time) when compared to the control group (t(22)=0.006, P=0.9950). ANOVA of motility time revealed no effect of treatment [F(3,50)=0.99; P=0.404, FIG. 32].

Conclusions

In this experiment, the vehicle MIA group did not exhibit altered intestinal motility compared to the control. Chronic treatment with MRX006 did not affect intestinal motility compared to the control or vehicle MIA groups.

Example 3 g—Organ Weight and Colon Length

For colon length, student's t-test did not reveal any significant difference between vehicle MIA and control groups (t(21)=1.26, P=0.26). ANOVA of colon of length did not reveal an effect of treatment [F(3,49)=0.69, P=0.57; FIG.

Figure 33A:
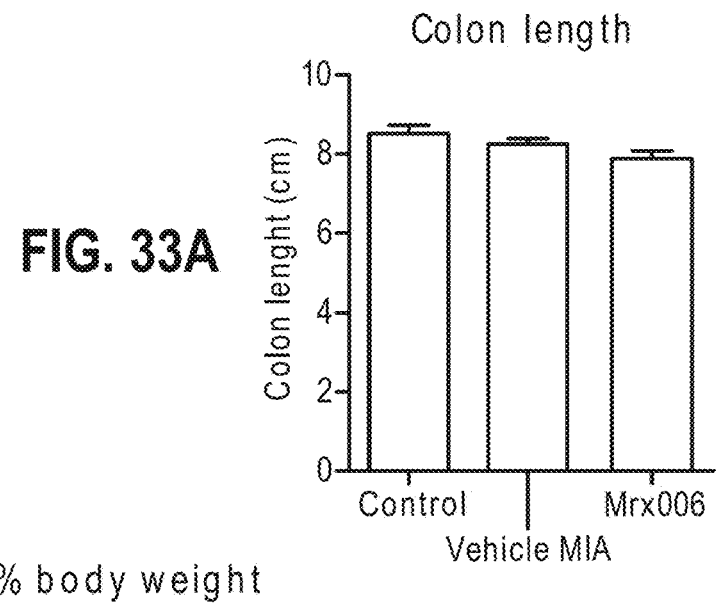
FIGS. 33A-33C: Effect of treatment with MRX006 on organ weight and colon length in MIA mice.
Figure 33B:
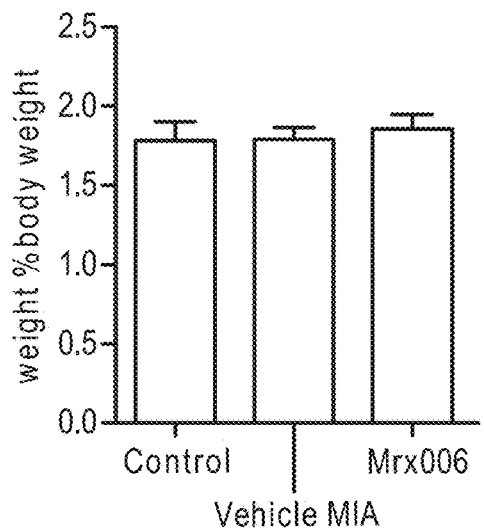
Figure 33C:
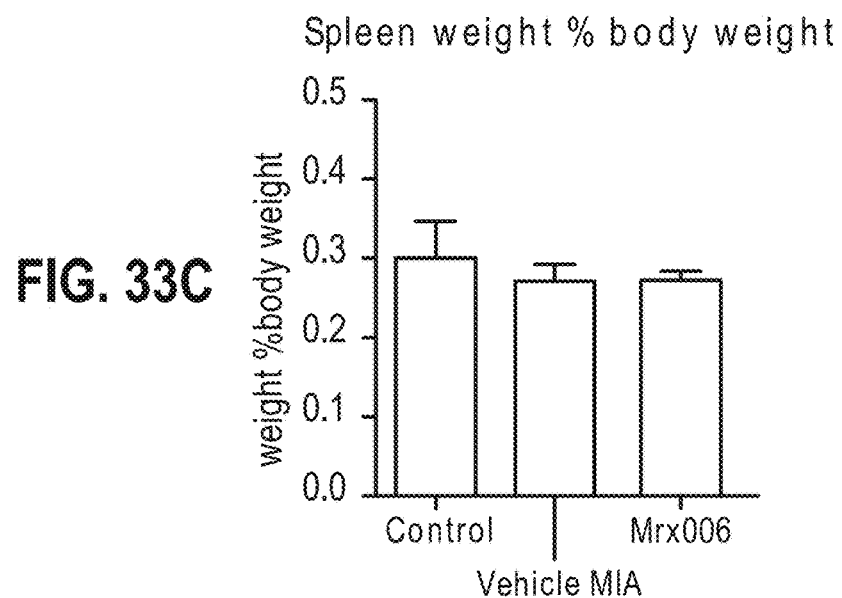

33A]. For caecum weight as a percentage of body weight, student's t-test did not reveal a significant difference between vehicle MIA and control groups (t(22)=0.56, P=0.58). ANOVA revealed no significant effect of treatment upon caecum weight [F(3,48)=0.84, P=0.48, FIG. 33B]. For spleen weight as a percentage of body weight, student's t-test did not reveal a significant difference between vehicle MIA and control groups (t(22)=0.64, P=0.53). ANOVA revealed no significant effect of treatment upon spleen weight [F(3,48)=2.25, P=0.09, FIG. 33C).

Conclusions

Treatment with MRX006 does not influence colon length or organ weight in the MIA mouse model of autism.

Discussion of Results from the MIA Mouse Model

Chronic treatment with MRX006 was able to reverse the phenotype observed in the marble burying test in MIA mice. Chronic treatment with MRX006 was able to reduce the number of marbles buried suggesting a reduction in stereotyped-like behaviour. Furthermore, chronic treatment with MRX006 decreased the distance travelled without having any effect on time spent in the inner and outer zones in the open field arena. Consequently, treatment with MRX006 may attenutate stress-induced locomotor activity caused by exposure to the open field arena. No significant effect of treatment was observed in the social transmission food and the female urine sniffing tests suggesting no directly observable effects in social and depressive-like behaviour in the MIA mouse model. The live biotherapeutic tested did not affect intestinal motility or permeability. Therefore, the MIA model has proven useful for assessing stereotyped-like, repetitive and anxious behaviour, but it did not recreate a number of other symptoms associated with autistic spectrum disorders. Nevertheless, the results display that chronic treatment with MRX006 may have a positive impact on the symptoms of autistic spectrum disorders.

Overall Conclusions Regarding MRX006 in the Treatment of Autistic Spectrum Disorders MRX006 was shown to be effective in the treatment of stereotyped and anxiety-like behaviours in both the BTBR and MIA mouse model. Therapies that reverse behavioural and biological phenotypes in mouse models of autism are expected to be effective against human disease.

The EMA Guidelines on the clinical development of medicinal products for the treatment of autism spectrum disorder state that, due to the heterogeneity of the diseases, it may not be possible to achieve a significant effect on all core symptoms with a single compound, and so short term efficacy has to be demonstrated on at least one core symptom. The MRX006 live biotherapeutic has shown effective treatment of at least one core symptom of autistic spectrum disorder, so it and related *Blautia* and *B. stercoris* strains are expected to be effective against human disease. Similarly, other central nervous system disorders or conditions display complex pathology with multiple different symptoms, and have few approved treatments. Therefore, it is understood that an effective treatment does not need to treat all symptoms of a central nervous system disorder or condition. A treatment would be considered therapeutically useful if it treated one of the symptoms associated with a central nervous system disorder or condition.

Example 4—Measurement of Circulating Cytokines in BTBR Mice

Methods and Results

Figure 34:
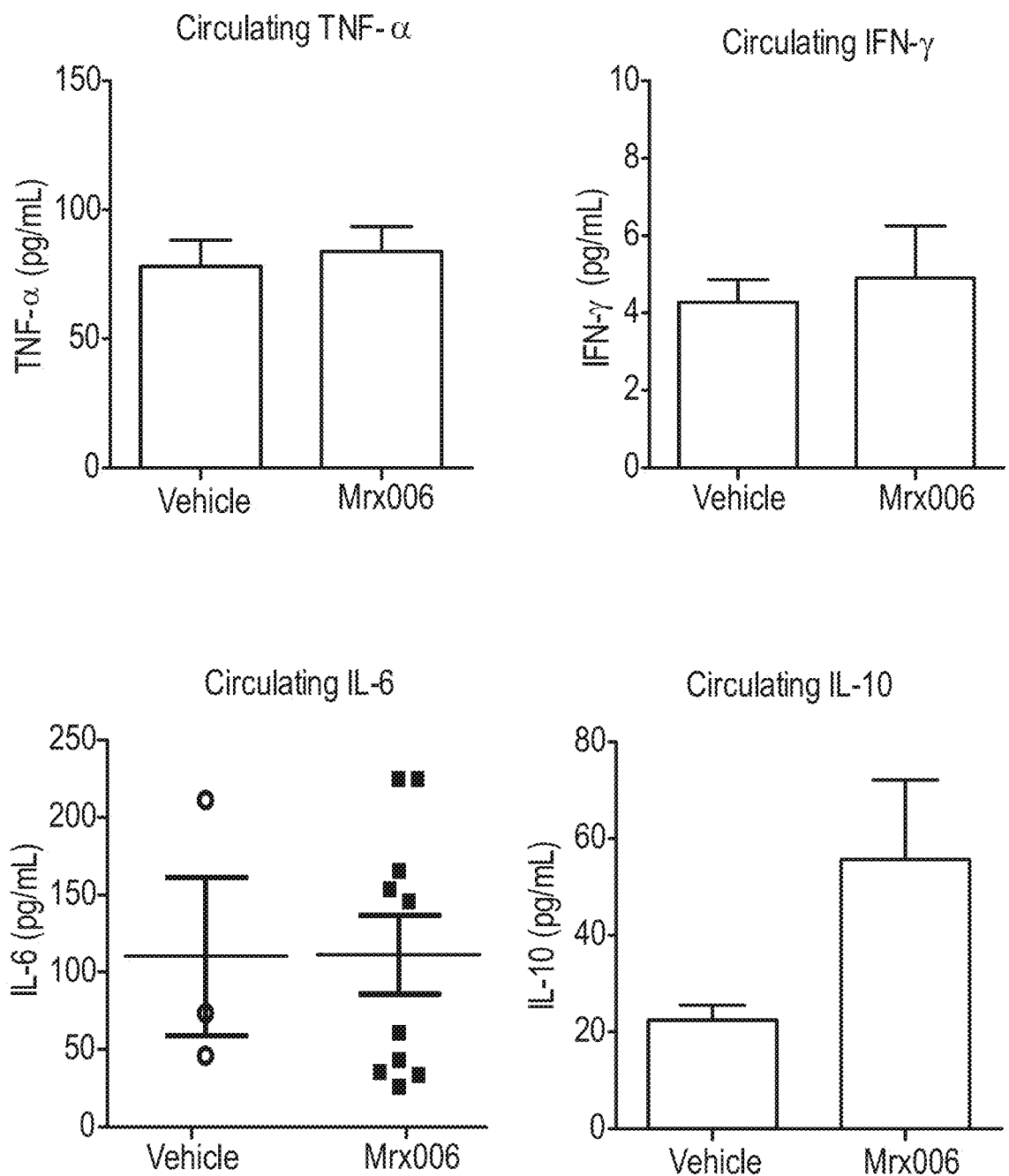
FIG. 34: Effect of treatment with MRX006 on circulating cytokine concentrations in BTBR mice.

Blood plasma was collected from trunk blood on the day of the culls from each animal at the end of the experiments. Circulating cytokines were assessed in plasma samples from vehicle and MRX006 groups using a commercially available electrochemilumenescence multiplex system (MSD, Galthersberg, MSD, USA). The following cytokines were assayed for: IL-1β, IL-4, IL-6, IL-10, IL-17A, IL-21, IL-23, TNF-α and IFN-β. Multiplex analysis revealed that levels of IL-1β, IL-4, IL-17A, IL-21 and IL-23 were below the limits of detection in both vehicle and MRX006 treated animals. For circulating TNF-α, student's t-test did not reveal a significant effect of treatment with MRX006 (t(21)=0.4264, P=0.6742, FIG. 34A). For circulating IFN-, student's test did not reveal a significant effect of treatment with Mrx006 (t(17)=0.4103, P=0.6867, FIG. 34B). For circulating IL-6, Student's t-test did not reveal a significant effect of treatment with MRX006 (t(11)=0.020, P=0.98, FIG. 34C). For circulating IL-10, chronic treatment with MRX006 causes a non-significant increase in IL-10 levels (t(13)=1.396, P=0.1861, FIG. 34D).

Conclusions

While there was no significant effect of MRX006 in terms of regulating circulating cytokine concentrations, there was a clear non-significant trend for an increase in circulating IL-10 following treatment with the live biotherapeutic. Such results suggest that MRX006 possesses immune-regulatory properties and can increase the production of anti-inflammatory cytokines. While the multiplex assay was performed upon plasma samples that contained basal, unstimulated cytokine concentrations, it will be interesting to assess whether MRX006 is capable of modulating IL-10 and other cytokines under stimulated conditions.

Example 5—Assessing the Effects of Subchronic Treatment with MRX006 Upon Central and Peripheral Oxytocin Levels in C57BL/6 Mice The bacterial strains were prepared and administered as outlined in the Examples above. The C57BL/6 mice were treated with live biotherapeutic for six days in 7 experimental treatment groups each with 10-12 mice. Subsequently, the hypothalamus was dissected from the mice and the levels of oxytocin in the hypothalamus were detected by radioimmunoassay (RIA), In addition, levels of oxytocin in the plasma were detected by RIA. Furthermore, the levels of oxytocin receptors, interleukins and other inflammatory markers, and vasopressin hormones were detected by RIA and other analytical methods.

Example 6—Stability Testing

A composition described herein containing at least one bacterial strain described herein is stored in a sealed container at 25° C. or 4° C. and the container is placed in an atmosphere having 30%, 40%, 50%, 60%, 70%, 75%, 80%, 90% or 95% relative humidity. After 1 month, 2 months, 3 months, 6 months, 1 year, 1.5 years, 2 years, 2.5 years or 3 years, at least 50%, 60%, 70%, 80% or 90% of the bacterial strain shall remain as measured in colony forming units determined by standard protocols.

Example 7—Administration of Another Live Biotherapeutic in the MIA Mouse Model

Example 7a—Materials and Methods for MIA Mouse Model

The mice, live biotherapeutic administration and fecal collection used in this Example are identical to those used in Example 3 above.

Strain

MRX008: *Blautia wexlerae*, bacteria deposited under accession number NCIMB 42486.

Administration Schedule

The treatment groups for the study are shown below. The vehicle for oral administration is PBS. Daily oral administration occurs via oral gavage.

| Group | Treatment | Number |
|---|---|---|
| 1 | Control (PBS, oral gavage) | 11 |
| 2 | Vehicle MIA (PBS, oral gavage) | 10 |
| 3 | MRX008 MIA (oral gavage in PBS) | 11 |

Experimental Design and Methods

Dosing with MRX008 or vehicle commenced when the mice were 8 weeks old. The behavioural battery occurred in the following order: marble burying test at week 5; social transmission of food preference at week 6 and the forced swimming test at week 8. The carmine red gastrointestinal motility assay and gastrointestinal permeability assay tail bleeds occurred during weeks 7 and 8 respectively. Finally, in week 9, the mice were killed for splenocyte stimulation and ex vivo measurement of FITC in the ileum and colon.

The effects of live biotherapeutic treatment in the MIA model on stereotyped, social and depression-like behaviours, along with gastrointestinal parameters (permeability and motility) are outlined in the following examples.

Group 2, listed in the table above, represents the maternal immune activation mice, the mothers of which were treated with poly (I:C) during pregnancy. These mice would be expected to show phenotypes associated with autistic spectrum disorders compared to the control mice (Group 1)—this control ensures that the poly (I:C) administration did cause the expected behavioural symptoms in the maternal mouse offspring. Any effect of treatment on the behavioural symptoms of autistic spectrum disorders would be identified by differences between Group 2 and Group 3.

Graphical Design and Statistical Analysis

All graphs were generated on graphpad prism software (version 5). Data were analysed using IBM SPSS Statistic 22.0 (EEUU). Data distribution was analysed using the Kolmogorov-Smirnov normality test. Data comparing vehicle group versus the MRX008 group were analysed using one-way ANOVA and Fisher's least significant difference (LSD) post hoc test. If ANOVA did not reveal a significant effect of treatment, a priori pairwise comparisons test against the control group was conducted. Non-normally distributed data were analysed by the Kruskal-Wallis and non-parametric Mann-Whitney U test. $P<0.05$ was the criterion for statistical significance.

Example 7b—Assessment of Stereotyped Behaviours—the Marble Burying Test

Rationale and Methods
See Example 3b above.

Results

Figure 35A:
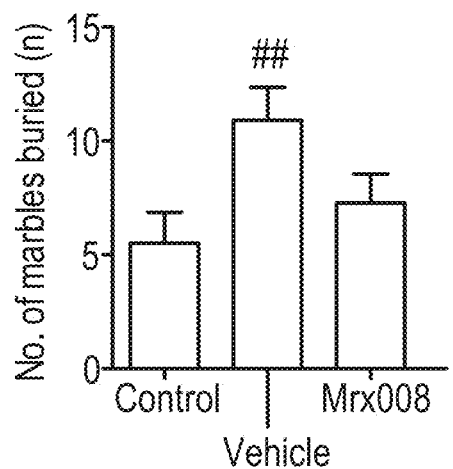
FIGS. 35A-35B: Effect of treatment with MRX008 on MIA mice in the marble burying test. $\#\#p<0.01$ relative to control group.
Figure 35B:
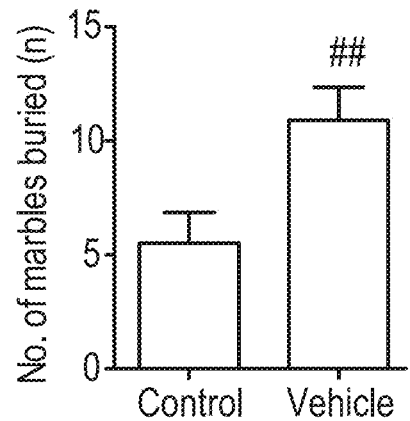

Student's t-test analysis between the control group and the vehicle MIA group revealed that the vehicle MIA mice buried more marbles compared to the control group (t(19)=3.00, P=0.007; FIG. 35). ANOVA of the number of marbles buried revealed an effect of treatment [F(3,42)=6.37, P=0.001]. Chronic treatment with MRX008 showed a reduction in the number of marbles buried relative to the vehicle MIA group.

Conclusions

The vehicle MIA group showed significantly more marbles buried than the control group, indicating that the MIA model successfully triggered autistic spectrum disorder-like symptoms in the mice. There is a trend towards a reduction in repetitive, compulsive and anxious behaviour in MIA mice upon chronic treatment with MRX008.

Example 7c—Assessment of Social Behaviours—Social Transmission of Food Preference Rationale and Methods
See Example 3c above.

Results

Figure 36A:
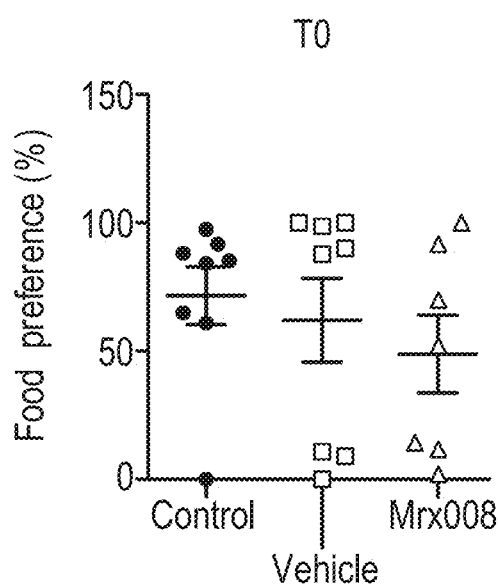
FIGS. 36A-36B: Effect of chronic treatment with MRX008 on MIA mice in the social transmission of food preference test.
Figure 36B:
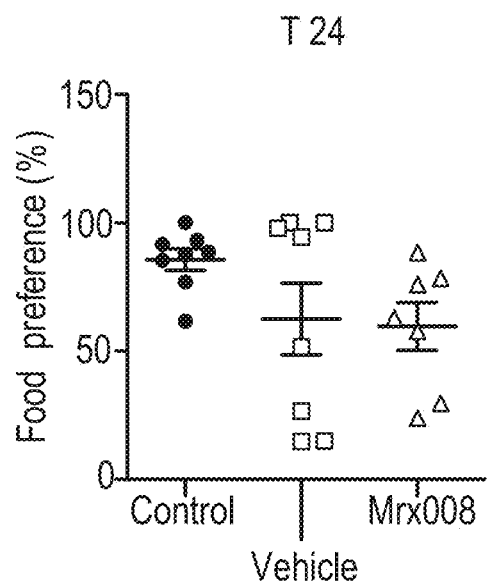

ANOVA of demonstrator cued food preference revealed no significant difference when observers were exposed to food choice immediately after demonstrator interaction (T0) (F(3,34)=0.38, P=0.77; FIG. 36A) or 24 hrs later (F(3,34)=0.85, P=0.48; FIG. 36B), irrespective of vehicle or MRX008 administration.

Conclusions

The vehicle MIA group did not display reduced social transmission food preference (the MIA vehicle displayed no alteration in food preference compared to the control), suggesting the MIA model has not triggered the reduced sociability phenotype. Accordingly, it is not possible to determine the effects of chronic treatment with MRX008 on sociability using the MIA mouse model.

Example 7d—Assessment of Depression-Like Behaviours—the Forced Swimming Test

Rationale

The forced swim test (FST) is the most widely used experimental paradigm to assess antidepressant activity ([57]). In this test, mice are forced to swim for 6 min and the behavioural parameter scored is immobility during the last 4 min of the 6-min test. naïve animals will display escape behaviour in the form of swimming, climbing and diving before adapting an immobile floating posture. The duration of immobility is indicative of behavioural despair. Antidepressant drugs decrease the time spent immobile in this test.

Methods

Mice are forced to swim for 6 min in a glass cylinder (24×21 cm) filled with 23-25° C. tap water to a depth of 17 cm. The FST was videotaped from a ceiling camera. The behavioural parameter scored is immobility during the last 4 min of the 6-min test.

Results

Figure 37:
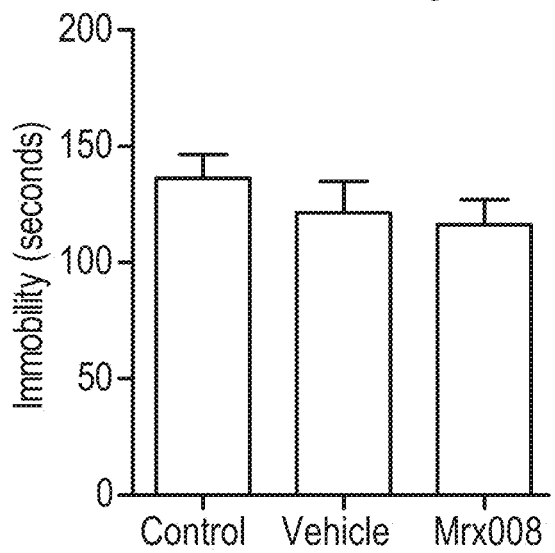
FIG. 37: Effect of chronic treatment with MRX008 on MIA mice in the forced swimming test.

Student's t test analysis revealed no significant differences on immobility time between the control group and vehicle MIA group (t=0.8968 df=20; 0.3805). ANOVA of immobility time did not reveal an effect of treatment with MRX008, although there appears to be a slight trend towards a reduction in time spent immobile after administration of MRX008 [F(3,42)=1.803; P=0.1625; FIG. 37].

Conclusions

The vehicle MIA group did not display increased immobility time in the forced swim test (the MIA vehicle displayed no alteration in immobility time compared to the control), suggesting the MIA model has not increased depressive-like symptoms. Accordingly, it is not possible to determine the effects of chronic treatment with MRX008 on depressive-like behaviour using the MIA mouse model.

Example 7e—In Vivo Intestinal Permeability Assay

Rationale

The MIA model has been reported to lead to changes in gut barrier function. Therefore, it was important to ascertain whether chronic treatment with the biotherapeutic affects intestinal permeability.

Methods

Test mice were single caged and food was removed overnight. Next day (at around 9 am) mice were administered by oral gavage with FITC dextran (Fluroscein-isothiocynate; MW: 4 kDa, Sigma; concentration: 600 mg/kg per animal of 80 mg/ml FITC in PBS (pH7.4)). Two hours following FITC administration, 100 μl of blood sample, from tail bleeds, was collected in heparin-coated capillary tubes and transferred to amber eppendorf and placed on ice. Samples were centrifuged 3500×g for 15 minutes, plasma was aspirated and samples were stored at −80° D for long storage.

Undiluted plasma was used to quantify FITC concentration. 25 μl of FITC was pipetted in duplicated in 384 well plate (Greiner bio one). FITC was measured with a Victor spectrometer between the ranges of 490 nm-520 nm. For a standard curve, a serial dilution of FITC was prepared in PBS (pH7.4).

In addition, after the cull of the mice in week 9, ex vivo measurements of FITC in the ileum and colon are performed.

Results

Figure 38:
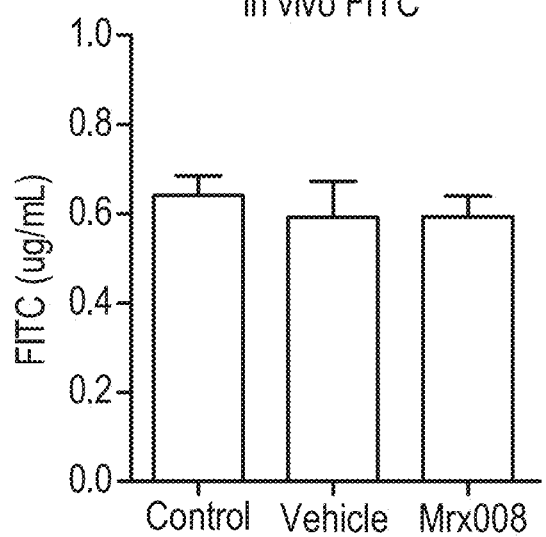
FIG. 38: Effect of chronic treatment with MRX008 on intestinal permeability.

Student's t test analysis revealed no differences between the control group and the MIA vehicle group ($t(20)=0.56$, $P=0.58$; FIG. 38). ANOVA of FITC concentrations did not reveal a significant effect of treatment [$F(3,39)=2.23$, $P=0.08$].

Conclusions

In this experiment, the vehicle MIA group did not display altered intestinal permeability (the MIA vehicle displayed no alteration in permeability compared to the control). Furthermore, chronic treatment with MRX008 did not affect intestinal permeability in MIA mice.

Example 7f—In Vivo Intestinal Motility Assay

Rationale and Methods

See Example 3f above.

Results

Figure 39:
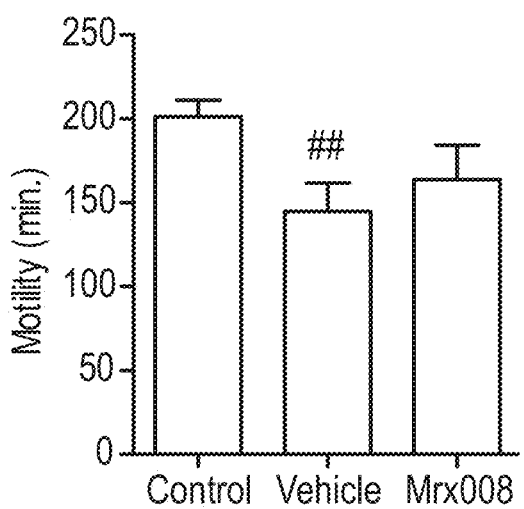
FIG. 39: Effect of chronic treatment with MRX008 on intestinal motility. $\#\#p<0.01$ relative to control group.

Student's t test analysis revealed that the vehicle MIA group exhibited increased intestinal motility (red pellet detected in less time) when compared to the control group ($t(19)=3.00$, $P=0.007$). ANOVA of motility time revealed no effect of treatment [$F(3,38)=0.74$, $P=0.54$; FIG. 39].

Conclusions

In this experiment, the vehicle MIA group displayed increased intestinal motility compared to the control. Chronic treatment with MRX008 did not affect intestinal motility compared to the control.

Example 8—Administration of Another Live Biotherapeutic in the BTBR Mouse Model

Example 8a—Materials and Methods for BTBR Mouse Model

The mice, live biotherapeutic administration and fecal collection used in this Example are identical to those used in Example 2 above.

Strain

MRX008: *Blautia wexlerae*, bacteria deposited under accession number NCIMB 42486.

Administration Schedule

The treatment groups for the study are shown below. The vehicle for oral administration is PBS. Daily oral administration occurs via oral gavage.

| Group | Treatment | Number |
|---|---|---|
| 1 | Control (PBS, oral gavage) | 10 |
| 2 | MRX008 (oral gavage in PBS) | 10 |

Experimental Design and Methods

As outlined above, dosing with MRX008 commenced when the mice were 8 weeks old. The initial dosing took place for 3 weeks before the behavioural experiments encompassing tests of sociability, anxiety, stereopathy and cognition. The behavioural battery occurred in the following order: marble burying test at week 4; the elevated plus maze at week 5; the open field and novel object recognition tests, and the social transmission of food preference tests at week 6; the female urine sniffing and social interaction tests at week 7, and the forced swimming test at week 9. The carmine red gastrointestinal motility assay and gastrointestinal permeability assay tail bleeds occurred during weeks 8 and 9 respectively. Finally, in weeks 10 to 11, the mice were killed for splenocyte stimulation and ex vivo measurement of FITC in the ileum and colon.

The effects of live biotherapeutic treatment in the BTBR model on stereotyped, social and depression-like behaviours, along with gastrointestinal parameters (permeability and motility) are outlined in the following examples.

Group 1, listed in the table above, represents the control BTBR mice, which would be expected to show phenotypes associated with autistic spectrum disorders. Any effect of treatment on the behavioural symptoms of autistic spectrum disorders would be identified by differences between Group 1 and Group 2.

Graphical Design and Statistical Analysis

All graphs were generated on graphpad prism software (version 5). Data were analysed using IBM SPSS Statistic 22.0 (EEUU). Data distribution was analysed using the Kolmogorov-Smirnov normality test. Data comparing vehicle group versus the MRX008 group were analysed using one-way ANOVA and Fisher's least significant difference (LSD) post hoc test. If ANOVA did not reveal a significant effect of treatment, a priori pairwise comparisons test against the control group was conducted. Non-normally distributed data were analysed by the Kruskal-Wallis and non-parametric Mann-Whitney U test. $P<0.05$ was the criterion for statistical significance.

Example 8b—Assessment of Social Behaviours—Social Transmission of Food Preference Rationale Social transmission food preference is a relevant test of olfactory memory that is used in mice to assess social behaviour. In this test, observer mice interact with a demonstrator mouse that has recently eaten novel food. When observer mice are presented with a choice between the food eaten by the demonstrator and some other novel food, observer mice should prefer the food eaten by the demonstrator. Reduced food preference would indicate reduced sociability.

Methods

This test was performed as previously described (Desbonnet, Clarke et al. 2015). Briefly, 18 hours prior to testing, mice were deprived of food, whereas water was available ad libitum. Food choices consisted of either 1% ground cinnamon or 2% powdered cocoa made with grounded mouse chow. A demonstrator mouse was randomly selected from each cage and the tail was marked using a blue marker to enable identification during subsequent social interactions. Demonstrator food containers were weighed before and after the 1 hour sampling sessions. A minimum of 0.2 g of consumed food was required for inclusion in the test. Demonstrator mice were placed back into their respective home cages for a 30 minute interaction period with cage-mates. Subsequently, cage-mates were individually tested for preference of cued food or novel food. Containers were weighed immediately before and after each choice session. Observed mice were then placed back into their respective home cages and the choice session was repeated 24 hours later. The test mice should smell the cinnamon or cocoa off the demonstrator mouse as a social cue, and preferentially choose the same food when given a choice between the two.

Results

ANOVA of demonstrator cued food preference revealed no significant difference when observers were exposed to food choice immediately after demonstrator interaction (T0) $(F(3,36)=1.123; P=0.354;$ FIG. 40A) or 24 hrs later $(F(3,38)=0.138; P=0.936;$ FIG. 40B).

Conclusions

Treatment with MRX008 did not affect the sociability of BTBR mice in the social transmission food preference test.

Example 8c—Assessment of Social Behaviours—Forced Intruder Test

Rationale and Methods

See Example 2c above.

Results

ANOVA of interaction time did not reveal an effect of treatment $[F(3,36)=1.905; P=0.1462;$ FIG. 41].

Conclusions

Treatment with MRX008 did not influence social behaviour of BTBR mice in the social interaction test.

Example 8d—Assessment of Stereotyped Behaviours—the Marble Burying Test

Rationale and Methods

See Example 2d above.

Results

ANOVA of the number of marbles buried did not reveal a significant effect of treatment $[F(3,39)=0.835; P=0.483;$ FIG. 42], although, chronic treatment with MRX008 does display a trend towards a reduction in number of marbles buried by BTBR mice.

Conclusions

Chronic treatment with MRX008 did not significantly affect repetitive, compulsive and anxious behaviour in BTBR mice, although it does display a trend towards reduced levels of this behaviour.

Example 8e—Assessment of Anxiety-Like Behaviour—the Elevated Plus Maze

Rationale and Methods

See Example 2f above.

Results

Figure 43A:
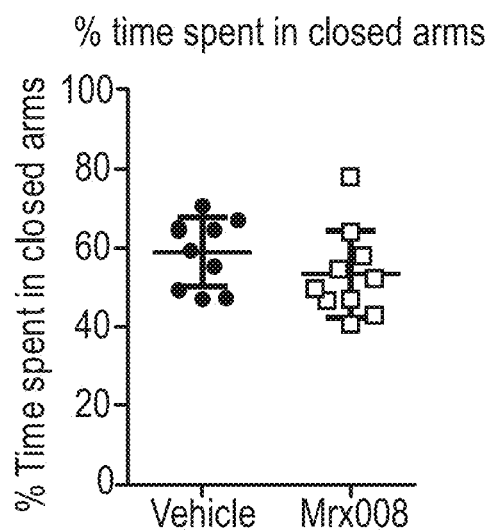
FIGS. 43A-43D: Effect of chronic treatment with MRX008 on BTBR mice in the elevated plus maze.
Figure 43B:
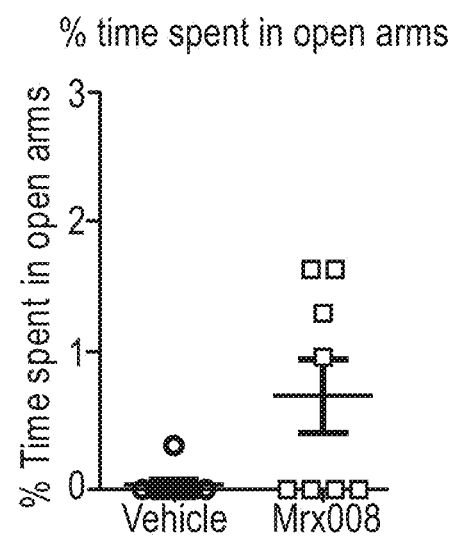
Figure 43C:
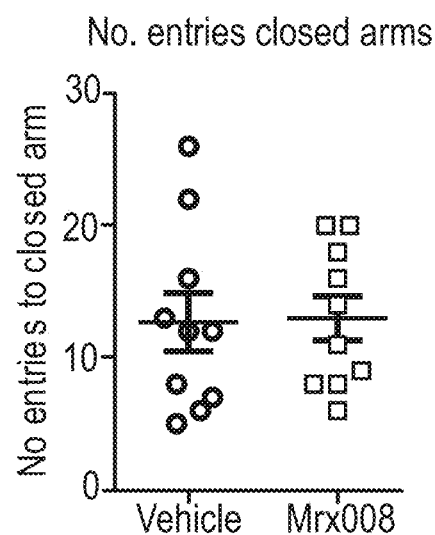
Figure 43D:
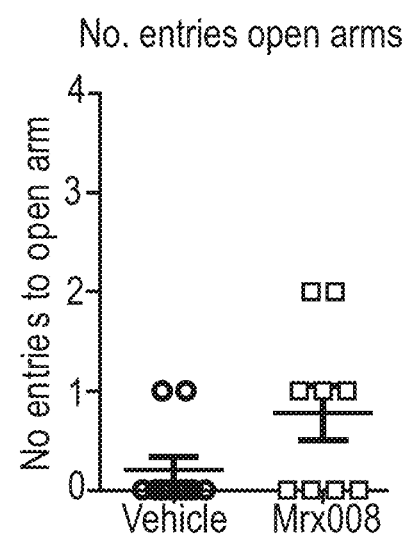

ANOVA of percentage time spent in closed arms revealed no effect of treatment $[F(3,39)=0.556; P=0.647;$ FIG. 43A]. Mice treated with MRX008 appear to spent more time in the open arms compared to the vehicle group (FIG. 43B). In line with this, chronic treatment with MRX008 appears to increased the number of entries into open arms compared to the vehicle group (FIG. 43D). ANOVA of the number of entries into the closed arms revealed no effect of treatment $[F(3,39)=0.556; P=0.647;$ FIG. 43C].

Conclusions

Chronic treatment with MRX008 shows a non-significant trends towards anti-anxiety behaviour in BTBR mice in the elevated plus maze.

Example 8f—Assessment of Anxiety-Like Behaviour—the Open Field Arena

Rationale and Methods

See Example 2 g above.

Results

Figure 44A:
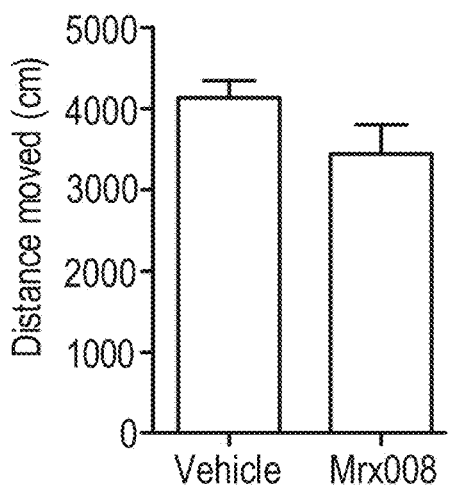
FIGS. 44A-44C: Effect of chronic treatment with MRX008 on BTBR mice in the open field arena. $*p<0.05$ relative to vehicle group as revealed by a priori pairwise comparisons.
Figure 44B:
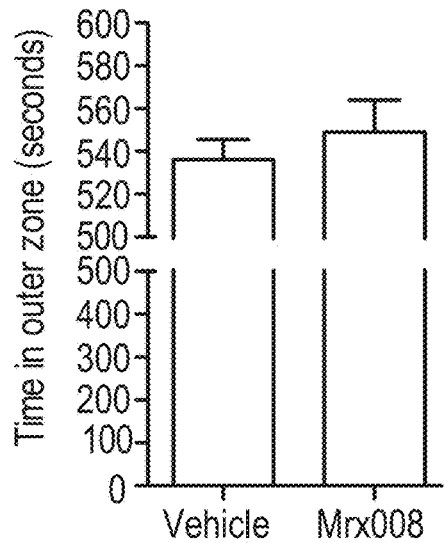
Figure 44C:
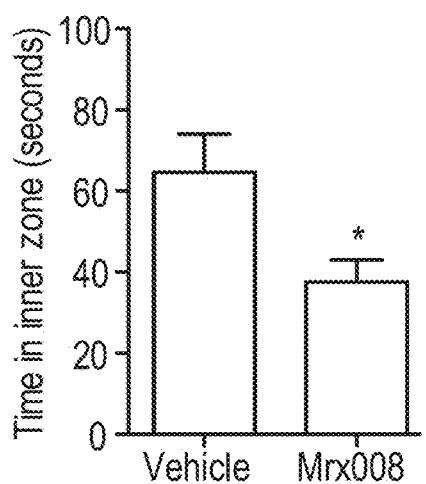

ANOVA of distance moved did not reveal a significant effect of treatment upon locomotor activity in the open field arena $[F(3,37)=1.325; P=0.282,$ FIG. 44A], although MRX008 appeared to reduce the distance moved, suggesting a reduction in stress-induced locomotor activity. ANOVA of time spent in the outer zone did not reveal an effect of treatment $[F(3,37)=1.598; P=0.208;$ FIG. 44B]. A priori pairwise comparison revealed that treatment with Mrx008 decreased the time spent in the inner zone $[t=2.388\ df=17; P=0.0288;$ FIG. 44C].

Conclusions

Chronic treatment with MRX008 shows a trend towards a reduction in stress-induced locomotor activity, but did show a reduction of time in the inner zone implicating anxiety-like behaviour.

Example 8 g—Assessment of Depression-Like Behaviour—the Forced Swimming Test

Rationale and Methods

See Example 2h above.

Results

Figure 45:
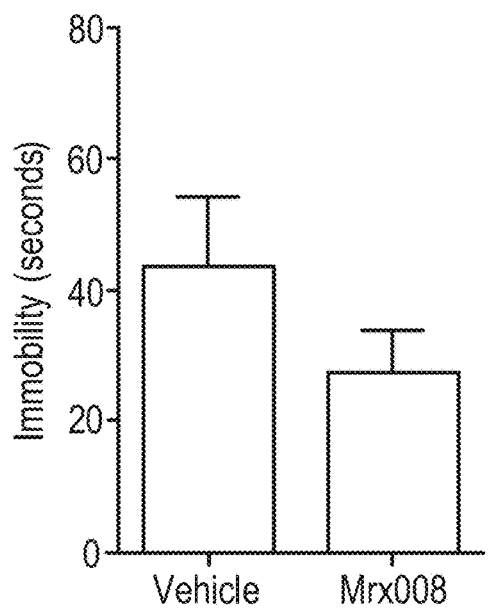
FIG. 45: Effect of chronic treatment with MRX008 on BTBR mice in the forced swim test.

ANOVA of immobility time did not reveal an effect of treatment on immobility time of BTBR mice in the FST $[F(3,38)=1.879; P=0.151;$ FIG. 45], although chronic treatment with MRX008 does cause a trend towards a reduction in the time spent immobile suggesting anti-depressant behaviour.

Conclusions

Treatment with MRX008 non-significantly reduces immobility time of BTBR mice in the forced swimming test implicating an anti-depressant effect of treatment.

Example 8h—Assessment of Depression-Like Behaviour—the Female Urine Sniffing Test Rationale and Methods See Example 2i above.

Results

Figure 46:
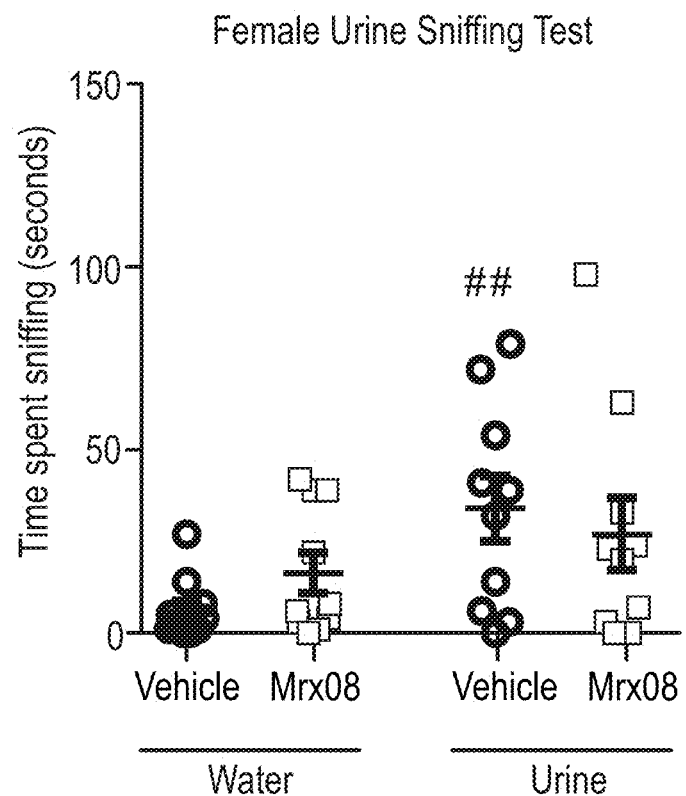
FIG. 46: Effect of chronic treatment with MRX008 on depressive-like behaviour in BTBR mice in the female urine sniffing test. $\#\#p<0.01$ relative to water vehicle group.

For the vehicle group, Mann-Whitney U test revealed a significant increase in the time spent sniffing urine relative to the time spent sniffing water [t=2.976 df=18; P=0.0081]. For exposure to water, Kruskal Wallis non-parametric analysis of time spent sniffing did not reveal an effect of treatment in the water group [Chi squared: 6.352; df=3; P=0.096]. For exposure to urine, Kruskal Wallis non-parametric analysis of time spent sniffing did not reveal an effect of treatment [Chi squared: 3.639; df=3; P=0.303, FIG. 46].

Conclusions

Treatment with MRX008 had no effect upon the time spent sniffing urine in BTBR mice.

Example 8i—In Vivo Gastrointestinal Motility Assay

Rationale and Methods

See Example 2m above.

Results

Figure 47:
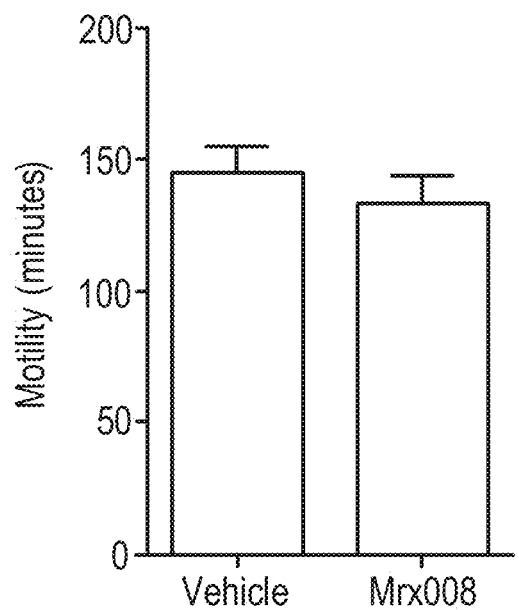
FIG. 47: Effect of chronic treatment with MRX008 on in vivo intestinal motility in BTBR mice.

ANOVA of motility time revealed no effect of treatment [F(3,39)=2.072; P=0.121; FIG. 47].

Conclusions

Treatment with MRX008 did not influence intestinal motility.

Example 8j—Organ Weight and Colon Length

Figure 48A:
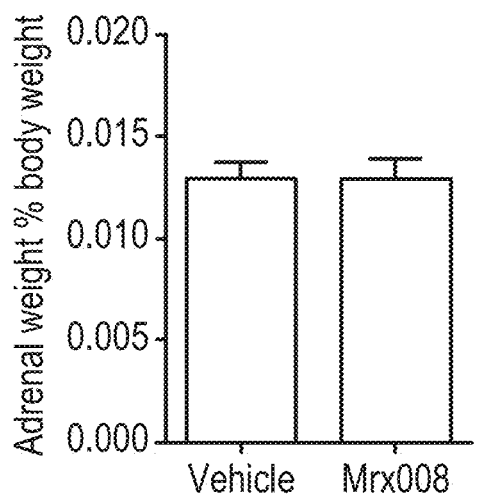
FIGS. 48A-48D: Effect of chronic treatment with MRX008 on selective anatomical markers in BTBR mice.
Figure 48B:
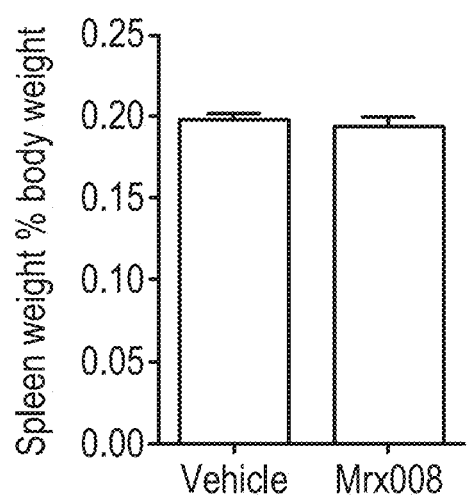
Figure 48C:
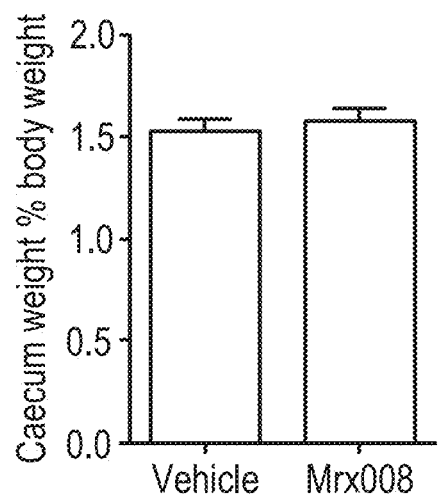
Figure 48D:
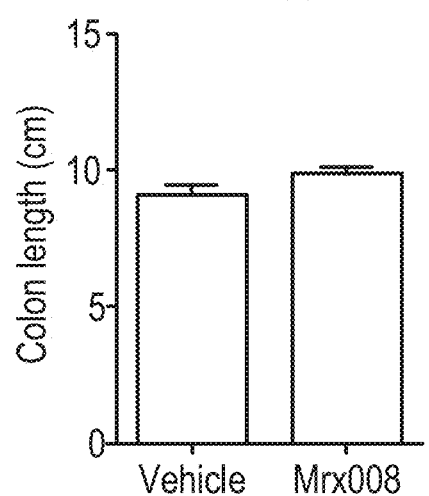

ANOVA of organ weight as a percentage of body weight did not reveal an effect of treatment for the adrenals [F(3,37)=0.208; P=0.890; FIG. 48A], spleen F(3,35)=0.629; P=0.601; FIG. 48B] or caecum [F(3,37)=0.883; P=0.460; FIG. 48C]. ANOVA of colon length did not reveal an effect of treatment [F(3,37)=5.635; P=0.003; FIG. 48D].

Overall Conclusions Regarding MRX008 in the Treatment of Autistic Spectrum Disorders The experiments disclosed herein display evidence that administration of another *Blautia* species (namely *Blautia wexlerae* MRX008) may be applicable for the treatment of neurodevelopmental and neuropsychiatric disorders in mice models. In particular, treatment with MRX008 displayed trends towards potential anti-anxiolytic effects as well as anti-depressive effects in the elevated plus maze and forced swim tests, respectively, in the BTBR mouse model, although the open field arena assay suggested MRX008 did not affect anxiety-like behaviour. In addition, the MRX008 may reduce stereotyped, repetitive and anxious behaviour as shown by the marble burying test in both the MIA and BTBR mouse models. Treatment with the MRX008 biotherapeutic did not alter the several physiological parameters measured in these studies.

The EMA Guidelines on the clinical development of medicinal products for the treatment of autism spectrum disorder state that, due to the heterogeneity of the diseases, it may not be possible to achieve a significant effect on all core symptoms with a single compound, and so short term efficacy has to be demonstrated on at least one core symptom. The MRX008 live biotherapeutic has shown effective treatment of at least one core symptom of autistic spectrum disorder, so it and related *Blautia* and *B. wexlerae* strains are expected to be effective against human disease. Similarly, other central nervous system disorders or conditions display complex pathology with multiple different symptoms, and have few approved treatments. Therefore, it is understood that an effective treatment does not need to treat all symptoms of a central nervous system disorder or condition. A treatment would be considered therapeutically useful if it treated one of the symptoms associated with a central nervous system disorder or condition.

Example 9—Assessing the Effects of Subchronic Treatment with MRX008 Upon Central and Peripheral Oxytocin Levels in C57BL/6 Mice The bacterial strains were prepared and administered as outlined in the Examples above. The C57BL/6 mice were treated with live biotherapeutic for six days in 7 experimental treatment groups each with 10-12 mice. Subsequently, the hypothalamus was dissected from the mice and the levels of oxytocin in the hypothalamus were detected by radioimmunoassay (RIA), In addition, levels of oxytocin in the plasma were detected by RIA. Furthermore, the levels of oxytocin receptors, interleukins and other inflammatory markers, and vasopressin hormones were detected by RIA and other analytical methods.

Figure 49A:
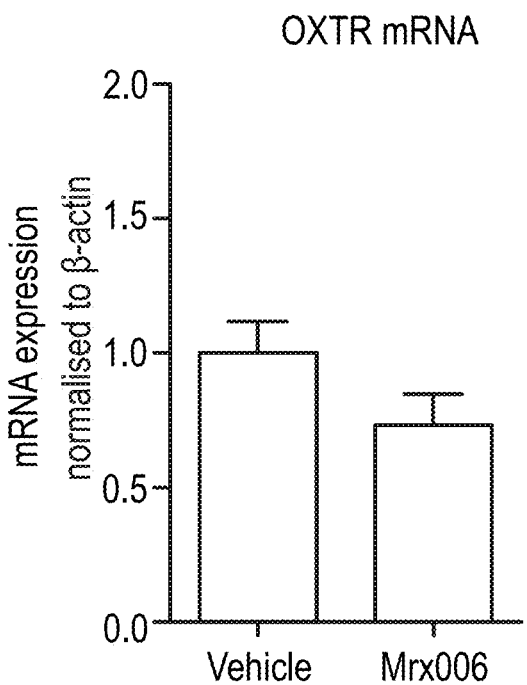
FIGS. 49A-49D: Effect of chronic treatment with MRX006 on expression of oxytoxin, vasopressin and their respective receptors in the hypothalamus of BTBR mice. $*p<0.05$ relative to the vehicle group.
Figure 49B:
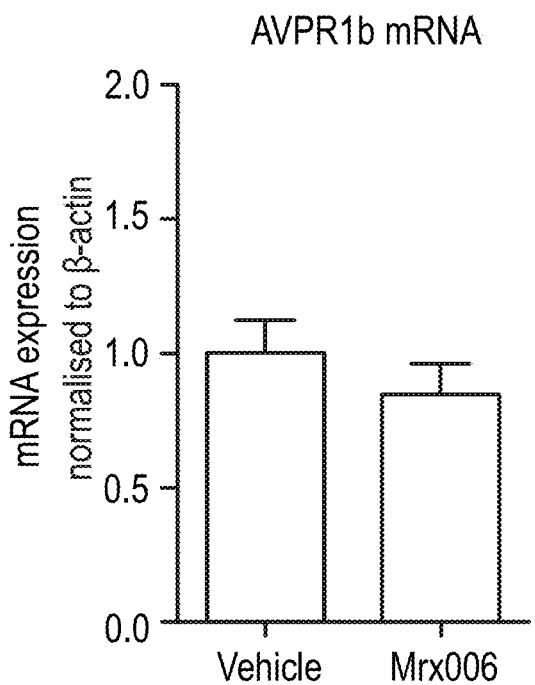
Figure 49C:
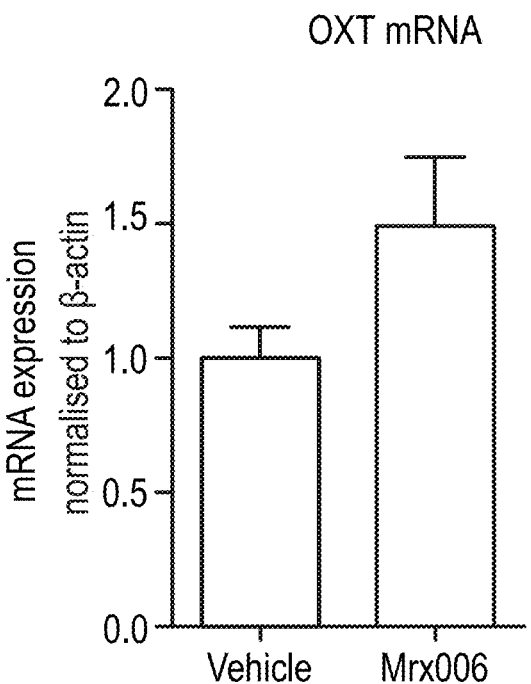
Figure 49D:
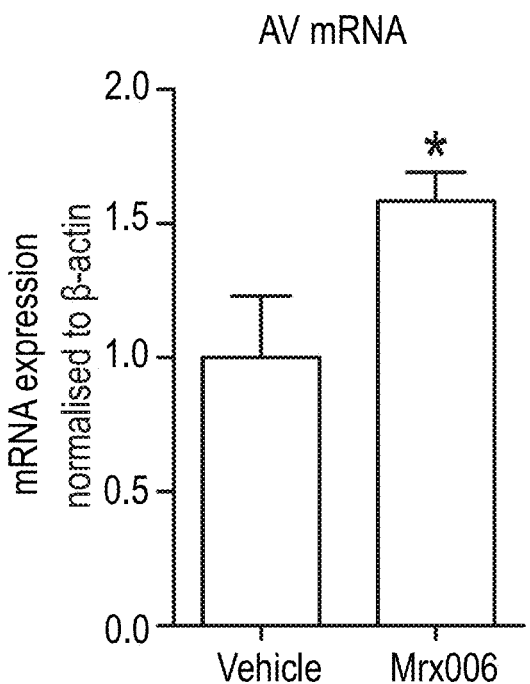
Figure 50A:
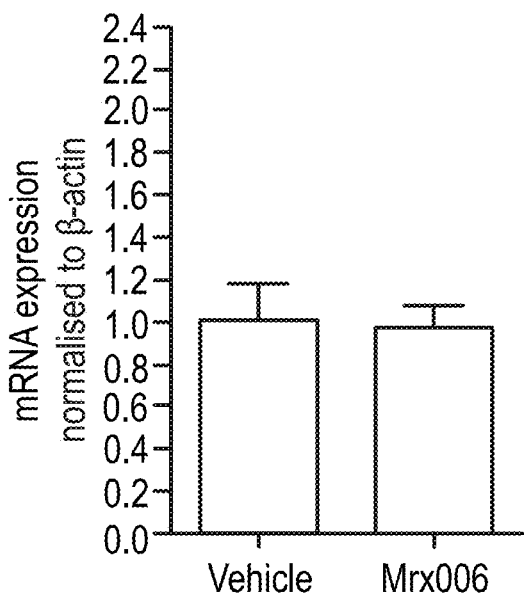
FIGS. 50A-50D: Effect of chronic treatment with MRX006 on expression of oxytoxin, vasopressin and their respective receptors in the amygdala of BTBR mice. $*p<0.05$ relative to the vehicle group.
Figure 50B:
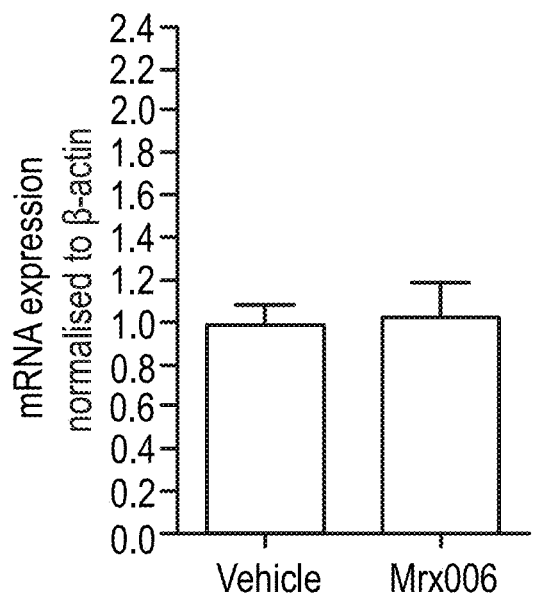
Figure 50C:
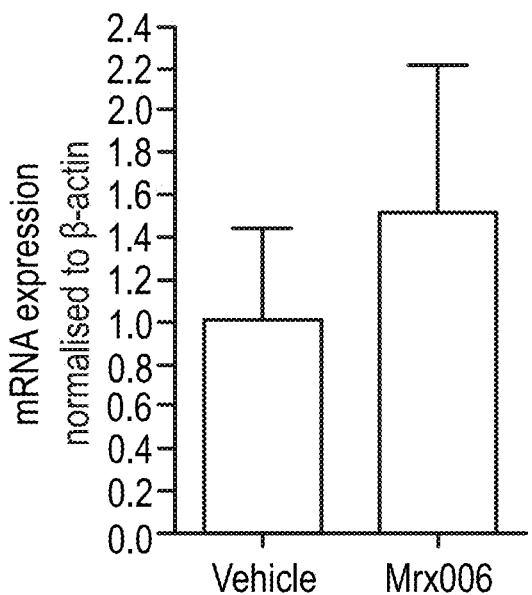
Figure 50D:
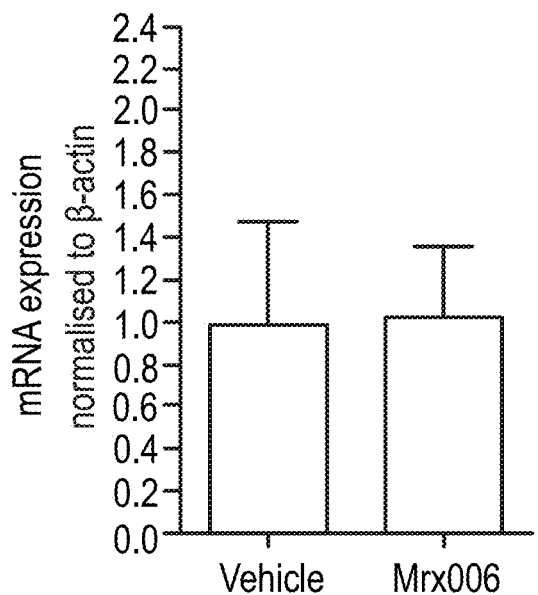

Example 10—Assessing the Effects of Chronic Treatment with MRX006 on Gene Expression Levels of Oxytocin, Vasopressin and Their Respective Receptors in the Hypothalamus and the Amygdala of BTBR Mice Chronic treatment with MRX006 increases the level of gene expression of oxytocin and vasopressin in the hypothalamus of BTBR mice (see FIGS. 49C and D). The effect on levels of oxytocin and vasopressin receptors in this tissue are shown in FIGS. 49A and B.

The effects of chronic treatment with MRX006 on the level of gene expression of oxytocin, vasopressin or their respective receptors in the amygdala of BTBR mice is shown in FIG. 50.

Therefore, chronic treatment with MRX006 increases the expression of vasopressin and oxytocin in the hypothalamus of BTBR mice. This striking result provides a correlation between chemical changes in the brain and behavioural changes upon administration of a live biotherapeutic. This is the first time any study has reported that a live biotherapeutic is capable of altering the central oxytocin/vasopressin system, with a concurrent change in social, anxiety-like and stereotyped behaviour with an improvement in gastrointestinal function.

Example 11—Administration of *Blautia hydrogenotrophica* in the C57BL/6 and BTBR Mouse Models In behavioural experiments using BTBR mice as a model for autism spectrum disorder and other neurological disorders, C57BL/6 mice administered both PBS and LYO were used as controls to confirm that the BTBR mice model effectively demonstrated increased anxiety, reduced social aversion, and increased stereotypes behaviours. This allowed an assessment of the effect of bacterial treatment on these ASD related behavioural defects.

Example 11a—Assessment of Anxiety-Like Behaviour—the Open Field Arena

Rationale and Methods

See Example 2 g above. The horizontal activity is the distance travelled by the mouse in the open field arena. The vertical activity is the number of occasions on which the mouse reared onto the hind legs. A higher frequency of these behaviours indicates increased locomotion and exploration and/or a lower level of anxiety. An increase frequency of these behaviours in the central area of the arena indicates high exploratory behaviour and low anxiety levels.

PBS is the negative control for the butyrate administration as the butyrate was administered in PBS. LYO is the negative control for the administration of the *Blautia hydrogenotrophica*. After the first analyses (FIGS. 51 A, C and E), the values for the negative controls of PBS and LYO in both the C57BL/6 and BTBR models are combined and averaged to provide a simplified comparison in the second analysis (FIGS. 51 B, D and F).

Results

Horizontal Activity

Figure 51A:
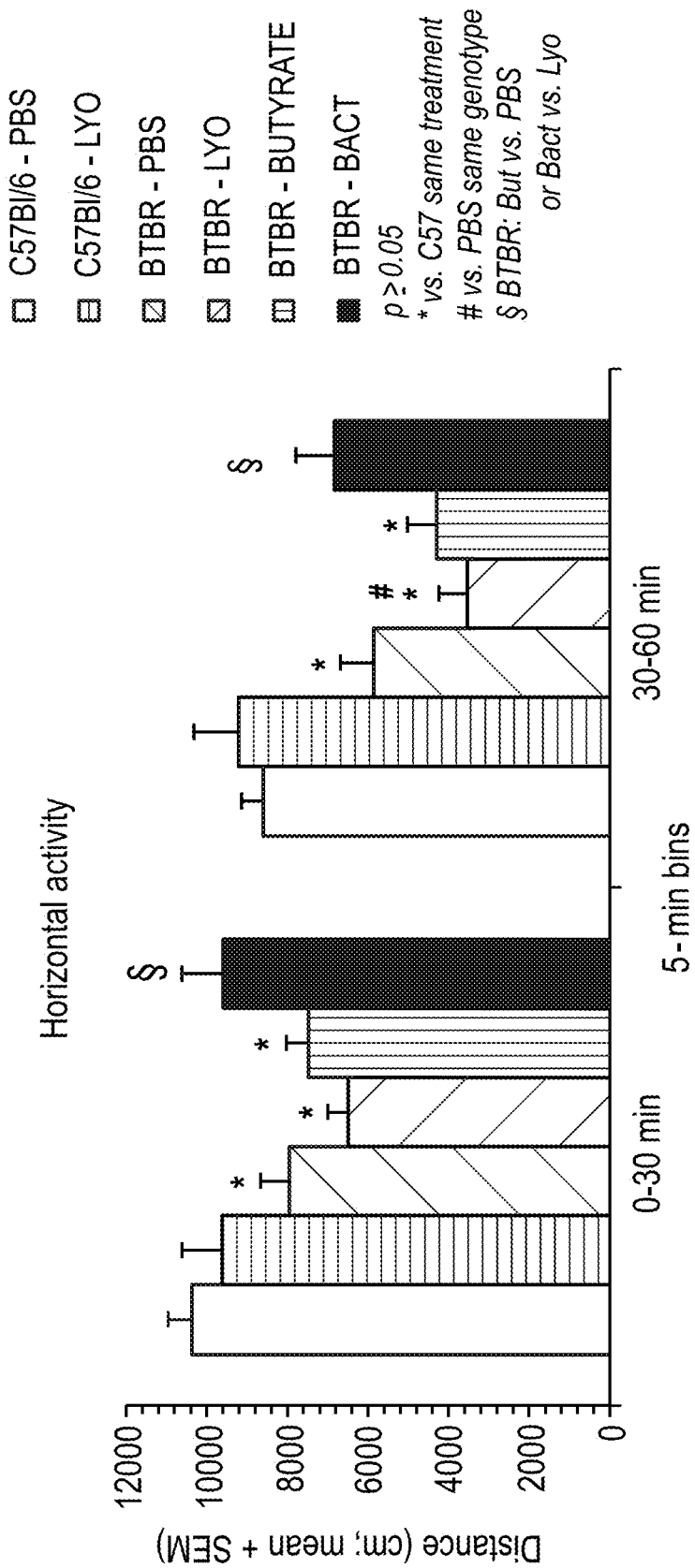

As would be expected from an anxiety and/or autism-related model, BTBR mice display significantly reduced horizontal activity compared to C57BL/6 mice. The LYO negative control showed no effect on the horizontal activity in C57BL/6 mice compared to the PBS control. Compared to the PBS control within the first 30 minutes, BTBR mice treated with the LYO control or butyrate alone showed no significant difference in distance travelled, although in the second 30 minutes, the LYO control reduced the distance travelled by BTBR mice. However, mice treated with the bacterial strain showed a significant increase in distance travelled compared to the BTBR control mice (FIG. 51A).

To provide a further comparison between the controls and the experimental values, as outlined above, the values for the PBS and LYO controls were combined in the second analysis. Similarly to the first analysis, the administration of butyrate did not affect the horizontal activity. However, the administration of the bacterial strain significantly increased the horizontal activity compared to the BTBR model control (FIG. 51B).

Vertical Activity

Figure 51C:
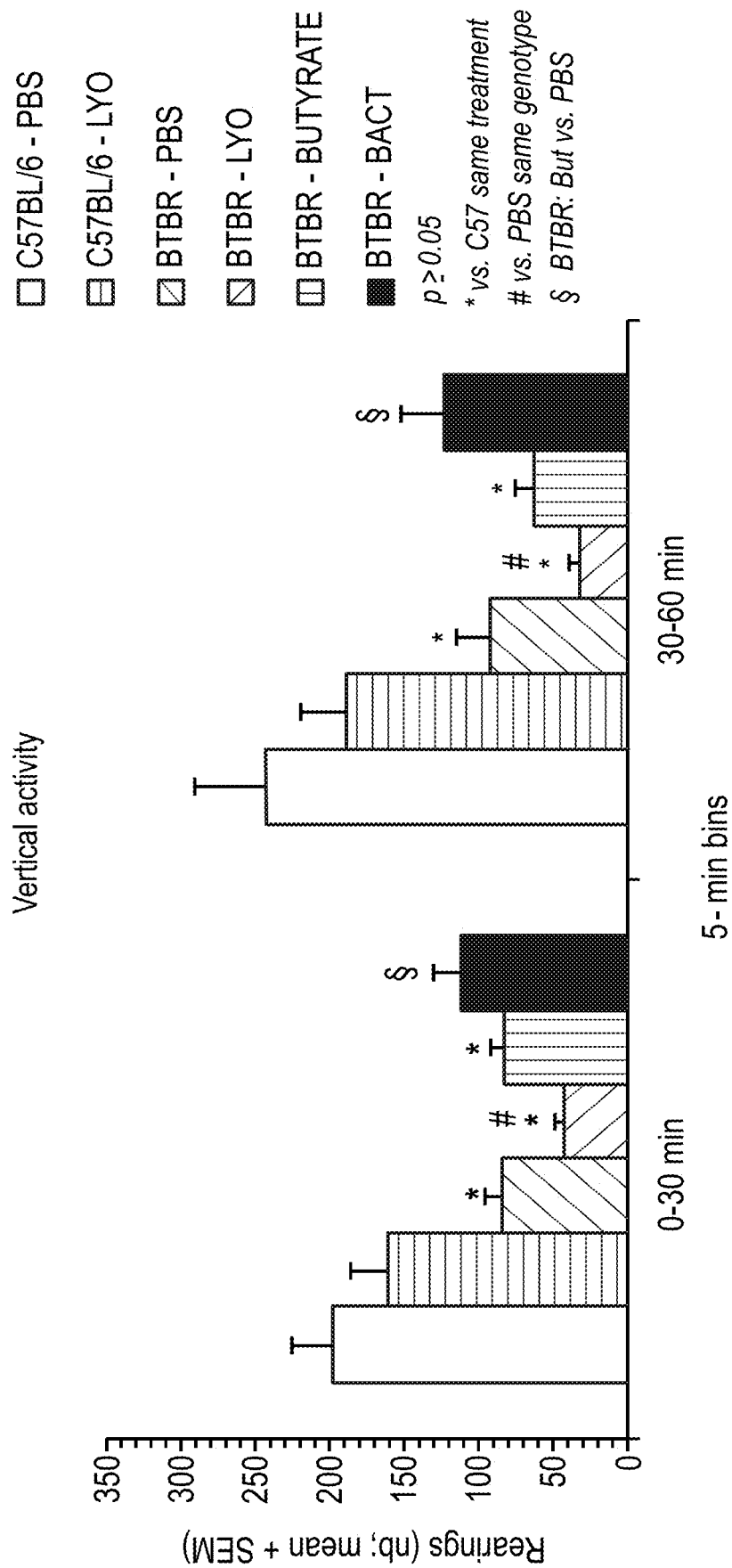

BTBR mice display significantly reduced vertical activity (rearing) compared to C57BL/6 mice. The LYO negative control showed no effect on the vertical activity in C57BL/6 mice compared to the PBS control. Compared to the BTBR PBS control mice, BTBR mice treated with butyrate alone showed no difference in rearing, while the LYO control reduced the vertical activity of BTBR mice. However, mice treated with the bacterial strain showed a significant increase in vertical activity compared to the BTBR LYO control mice (FIG. 51C).

Figure 51D:
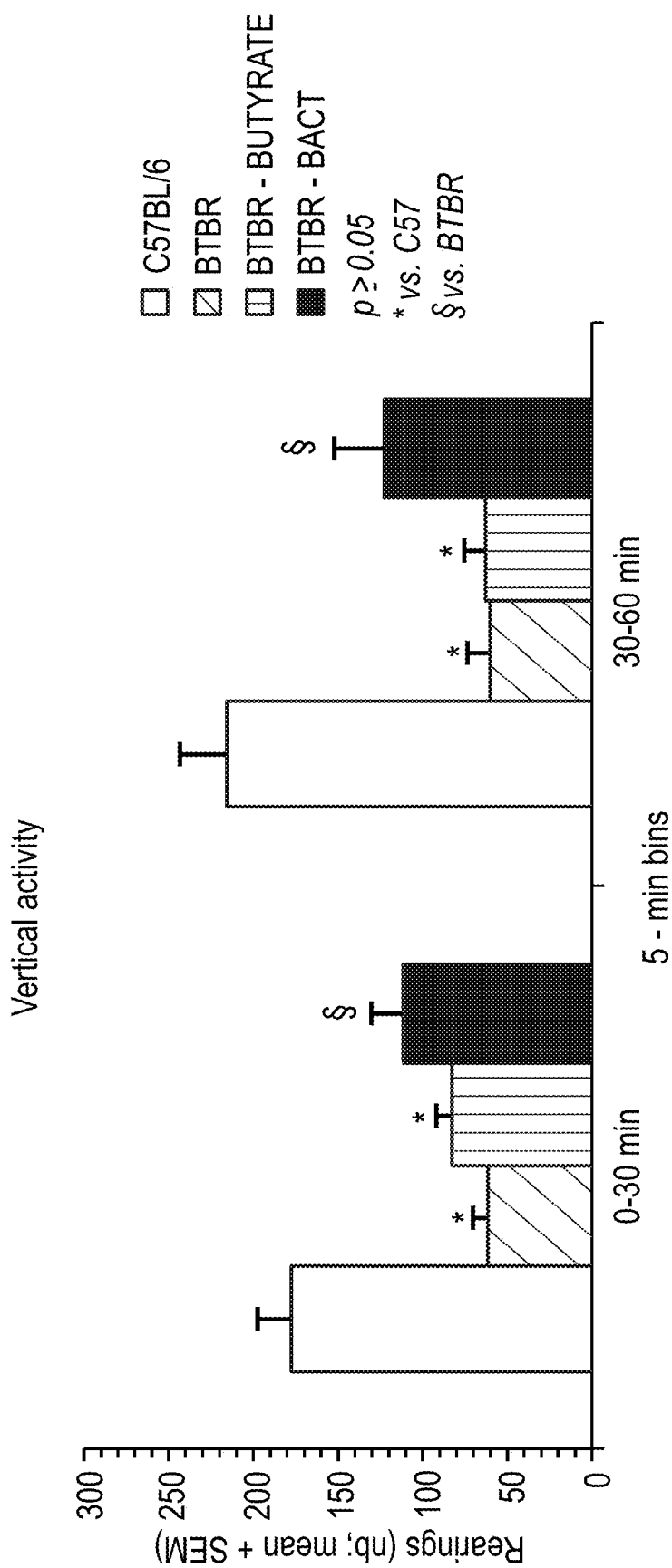

To provide a further comparison between the controls and the experimental values, as outlined above, the values for the PBS and LYO controls were combined in the second analysis. Similarly to the first analysis, the administration of butyrate did not affect the vertical activity of BTBR mice. However, the administration of the bacterial strain significantly increased the vertical activity compared to the BTBR control (FIG. 51D).

% distance travelled in the centre of the open field in the first 5 minutes

Figure 51E:
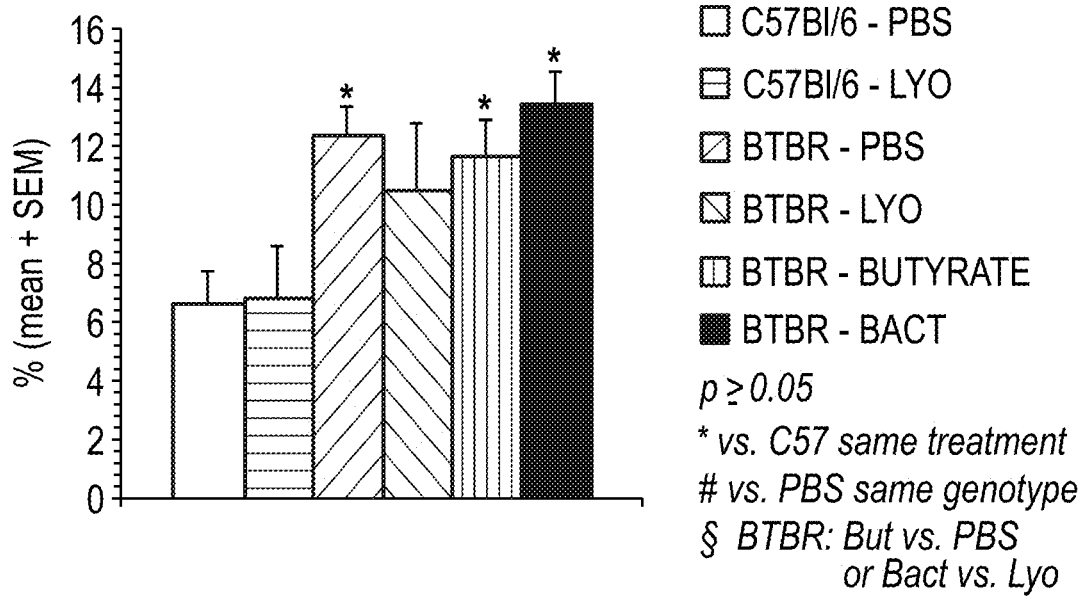

As would be expected, in the first five minutes of the analysis BTBR mice showed an increased percentage of their distance travelled in the centre of the open field arena compared to C57BL/6 mice. This is reflective of the reduced overall distance travelled by the BTBR mice, which display increased anxious behaviour, and the fact that within the first 5 minutes of the assay, the more anxious BTBR mice are more likely to familiarise themselves with their initial environment rather than enter an exploratory phase (FIG. 51E).

Figure 51F:
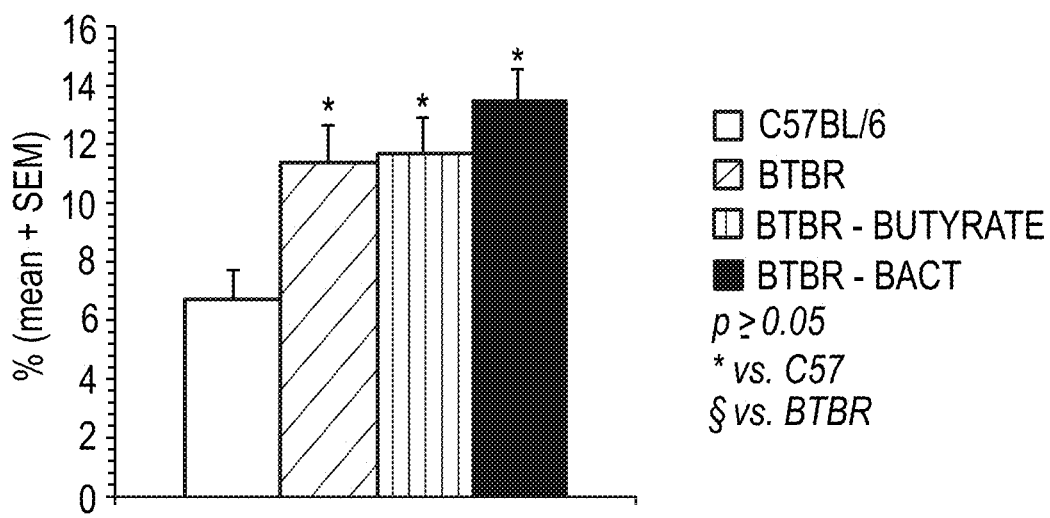

To provide a further comparison between the controls and the experimental values, as outlined above, the values for the PBS and LYO controls were combined in the second analysis (FIG. 51F).

% time spent in the centre of the open field arena

Figure 51G:
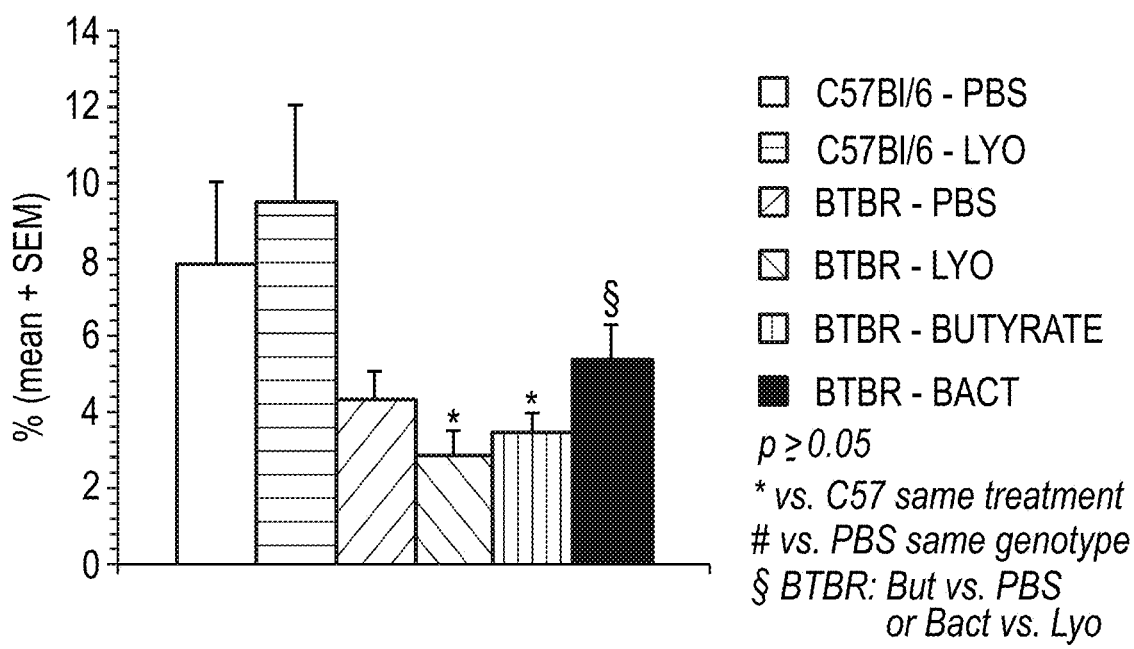
Figure 51H:
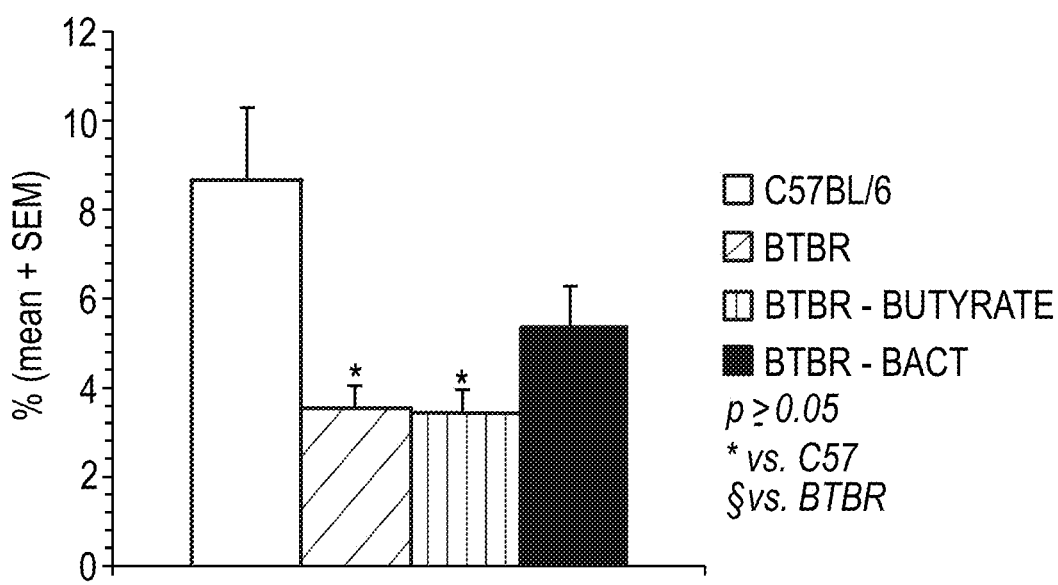

When considering the entire time of the analysis, BTBR mice show a reduced percentage time spent in the centre of the arena compared to C57BL/6 mice. This is reflective of the increased anxiety and reduced horizontal activity of the BTBR mice. Neither the LYO control nor butyrate alone affected the time spent in the centre of the arena. However, the administration of the bacterial strain significantly increased the amount of time spent in the centre of the arena compared to the LYO control in BTBR mice (FIG. 51G).

To provide a further comparison between the controls and the experimental values, as outlined above, the values for the PBS and LYO controls were combined in the second analysis. Similarly to the first the administration of butyrate did not affect the time spent in the centre of the field compared to the BTBR control. The administration of the bacterial strain increased the amount of time spent in the centre of the open field.

Conclusions

The chronic treatment with a composition of *Blautia hydrogenotrophica* increases exploratory activity and reduces anxiety-like behaviour in the BTBR mouse model in the open field arena test. Critically, administration of the bacterial strain to the BTBR mouse model increased horizontal and vertical activity and increased the total amount of time spent in the centre of the arena compared to the BTBR control. Accordingly, this bacterial strain has anxiolytic effects and improves exploratory behaviour in a mouse model representative of central nervous system disorders (e.g. autism spectrum disorders).

Example 11b—Assessment of Stereotyped Behaviours—the Marble Burying Test

Rationale and Methods

See Example 2d above. PBS is the negative control for the administration of butyrate. LYO is the negative control for the administration of the *Blautia hydrogenotrophica* strain. After the first analyses (FIG. 52 A), the values for the negative controls of PBS and LYO in both the C57BL/6 and BTBR models are combined and averaged to provide a simplified comparison in the second analysis (FIG. 52B).

Results

Figure 52A:
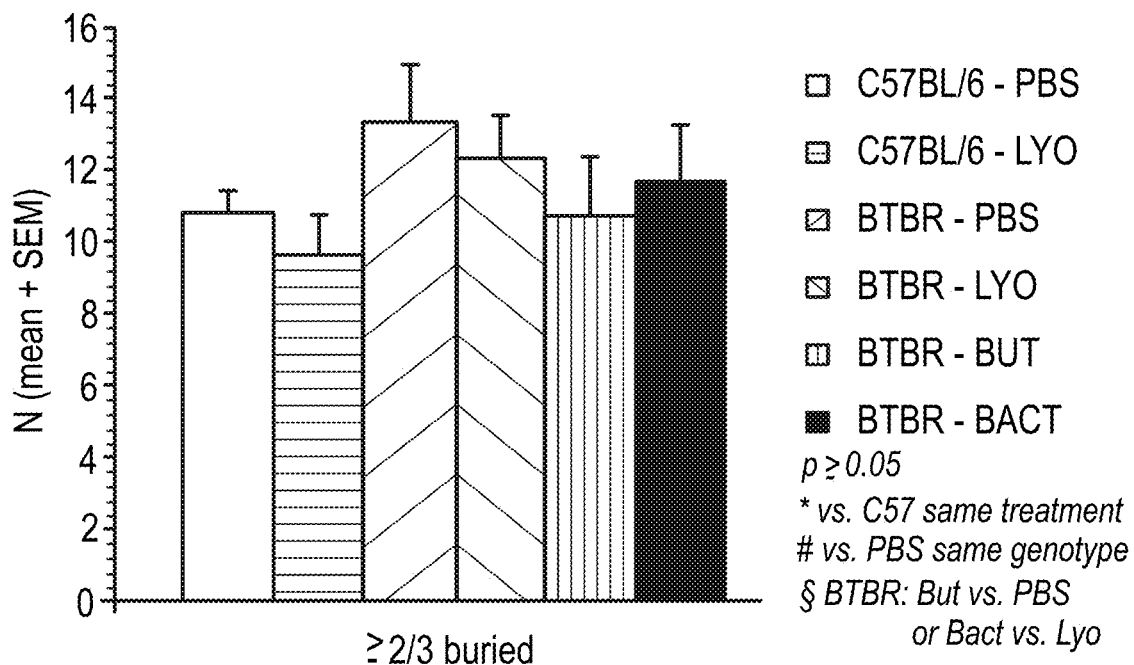
FIGS. 52A-52B: Effect of chronic treatment with Blautia hydrogenotrophica and butyrate on BTBR mice in the marble burying test. The data in FIG. 52B are identical to that in FIG. 52A, except the PBS and LYO control numbers have been pooled. $p\leq0.05$: * vs. C57BL/6 (same treatment, where applicable); # vs. PBS same genotype; § BTBR: But vs. PBS or Bact vs. Lyo. PBS is the negative control for butyrate administration; LYO is the negative control for bacterial (Blautia hydrogenotrophica) administration; BUT is the experimental administration of butyrate; BACT is the experimental administration of Blautia hydrogenotrophica.
Figure 52B:
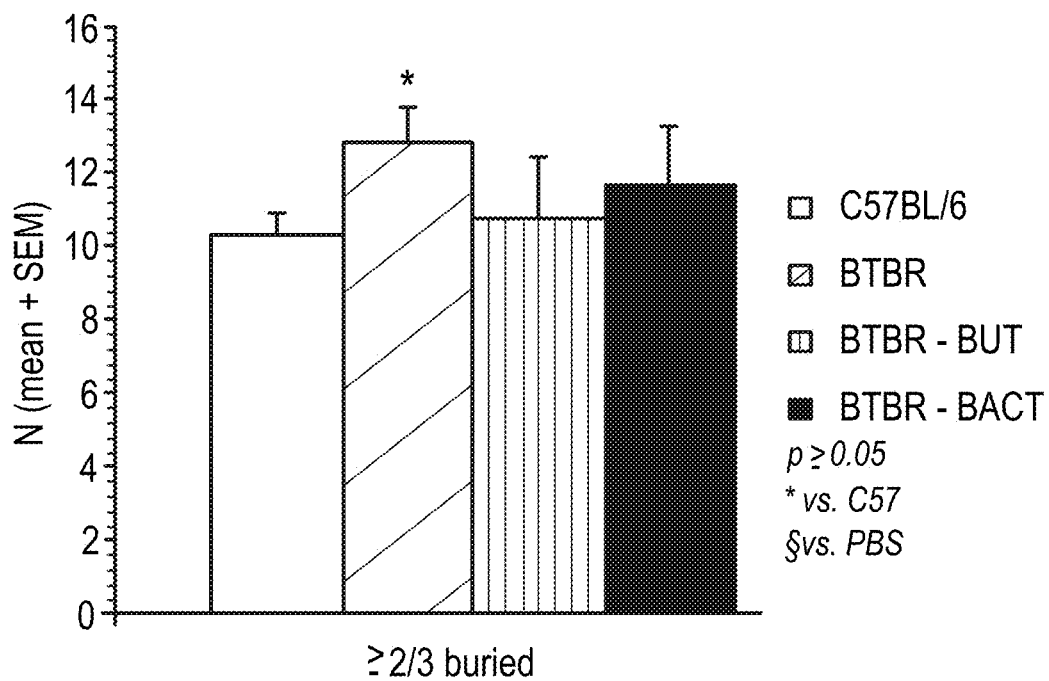

As would be expected, the BTBR model mice displayed an increase in repetitive behaviour showing significantly more marbles buried compared to the C57BL/6 model control (FIG. 52B). The administration of butyrate and the bacterial strain reduced the number of marbles buried (FIGS. 52A and B).

Conclusion

Administration of butyrate and/or the bacterial strain reduces the number of marbles buried, indicating a reduction in anxious or stereotyped behaviours.

Example 11c—Assessment of Stereotyped Behaviours—the Digging Test

Rationale and Methods

Similar to the rationale of the marble burying test, increased digging behaviour corresponds to an increase in repetitive and stereotyped behaviour.

Results

Figure 53A:
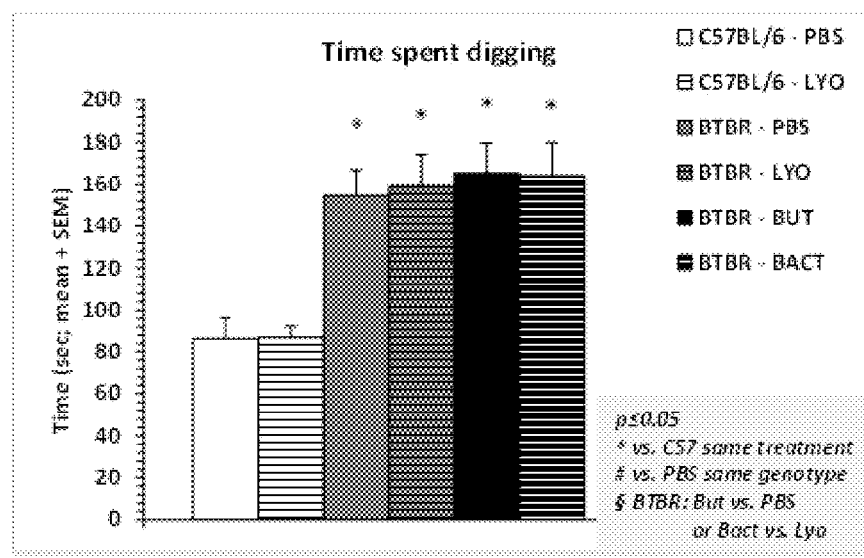
FIGS. 53A-53B: Effect of chronic treatment with Blautia hydrogenotrophica and butyrate on BTBR mice in the digging test.
Figure 53B:
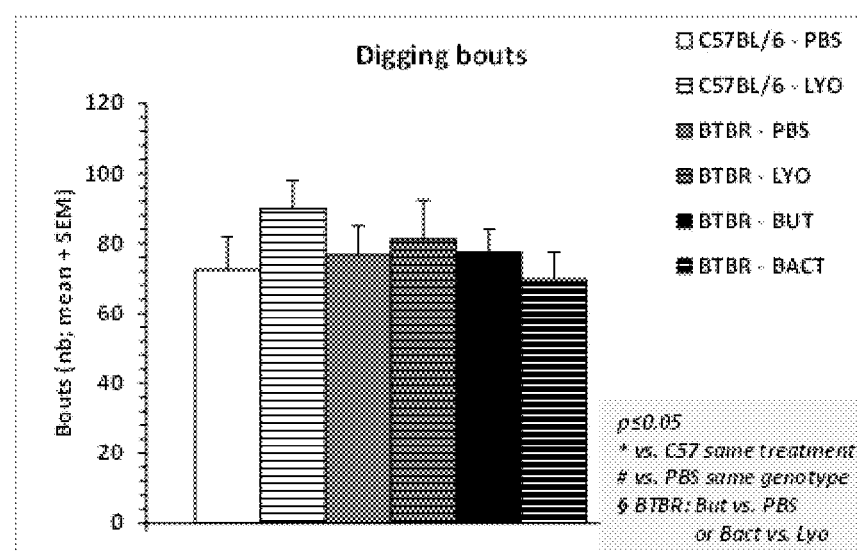

As would be expected, there was a significant increase in time spent digging in the BTBR model compared to the C57BL/6 control strain (FIG. 53A). However, the number of digging bouts was not significantly different between the C57BL/6 and BTBR strains (FIG. 53B). Therefore, it is not possible to assess the role of the bacterial strain or butyrate in preventing repetitive behaviour in this analysis.

Example 11d—Assessment of Stereotyped Behaviours—the Self-Grooming Test

Rationale and Methods

Figure 54A:
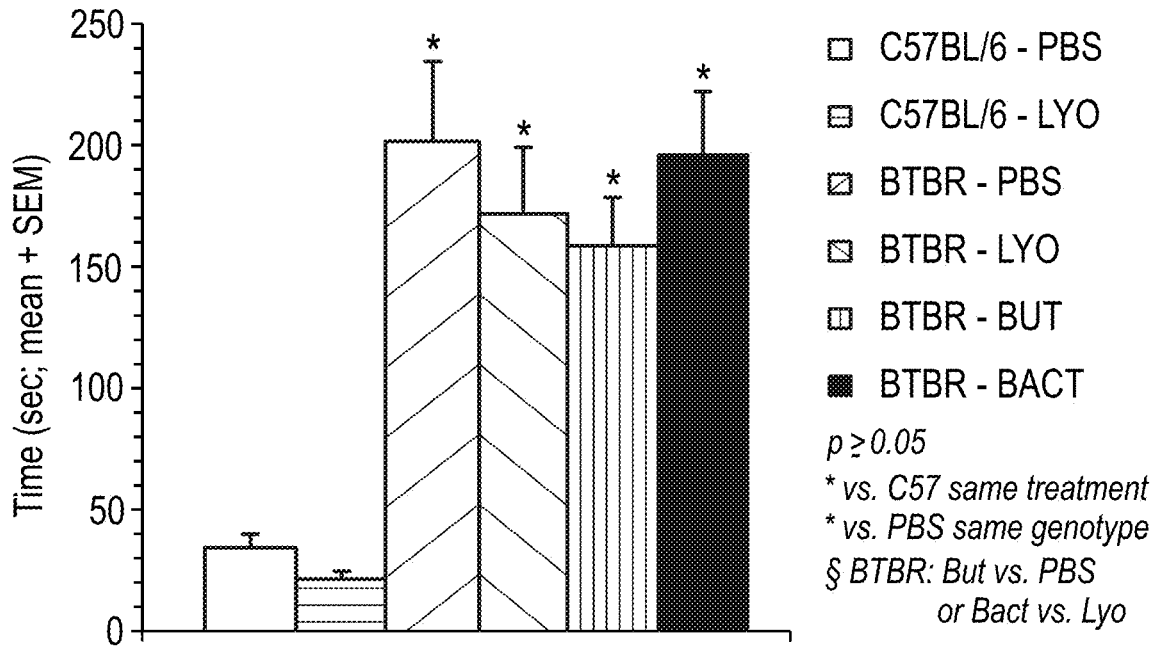
FIGS. 54A-54F: Effect of chronic treatment with Blautia hydrogenotrophica and butyrate on BTBR mice in the self-grooming test.
Figure 54B:
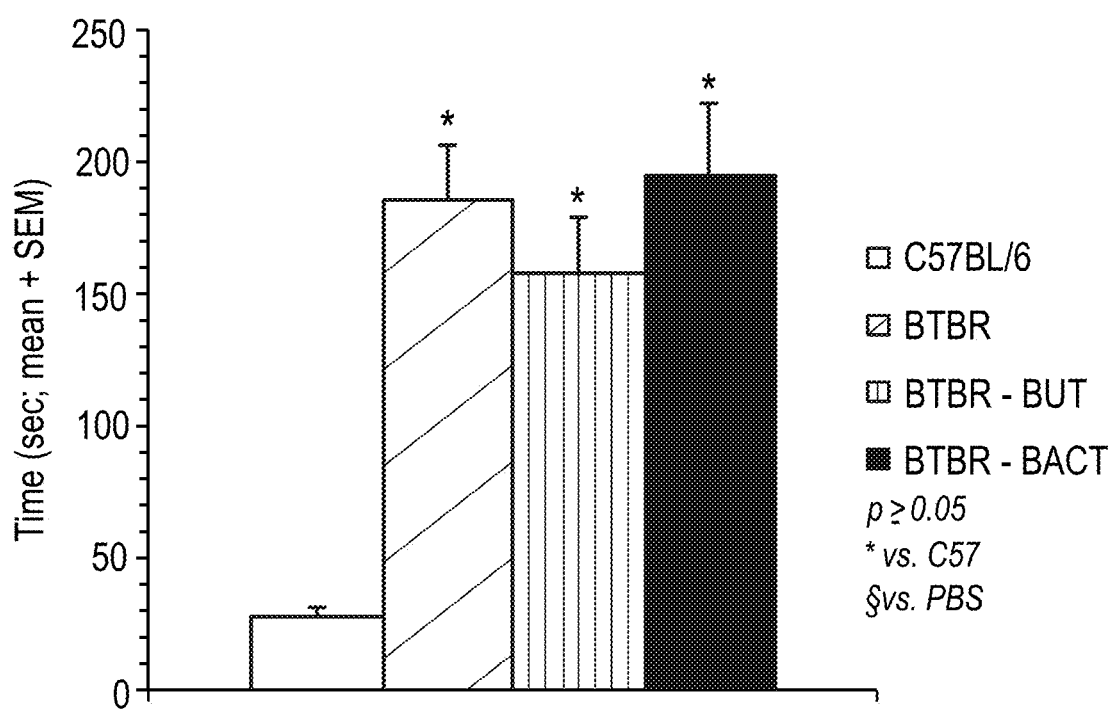
Figure 54C:
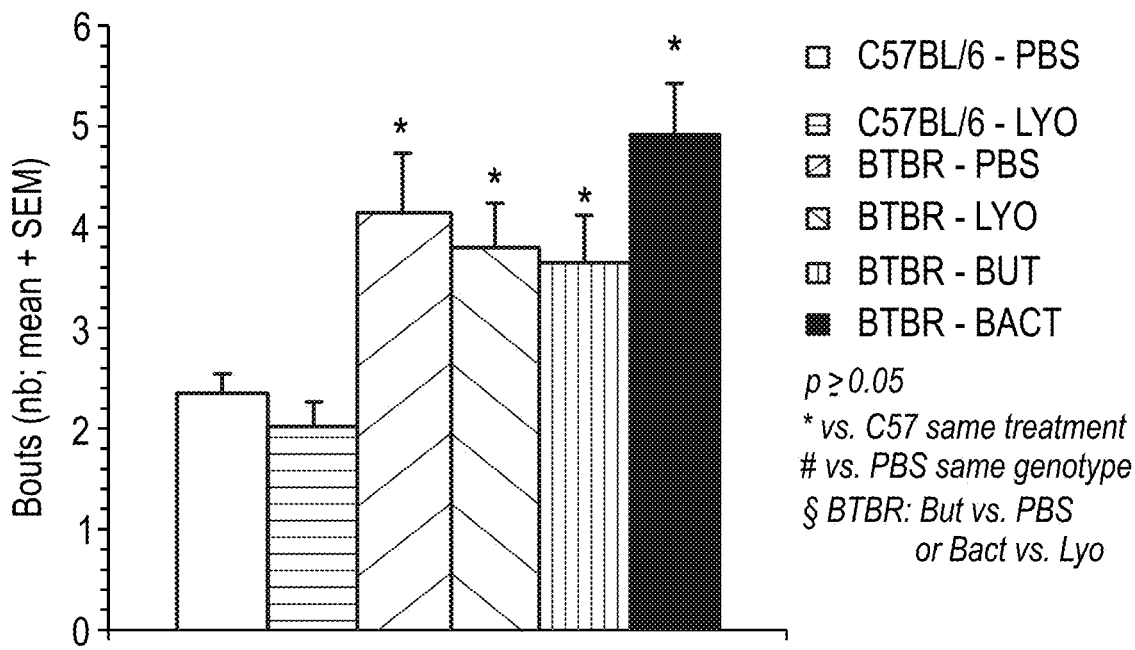
Figure 54D:
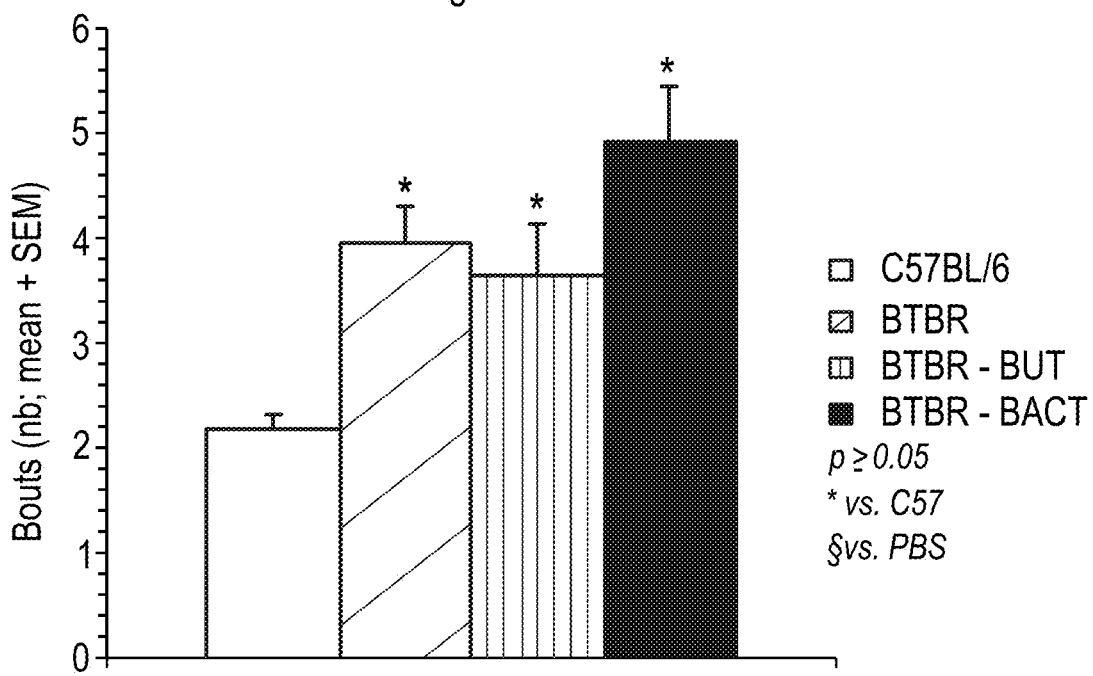
Figure 54E:
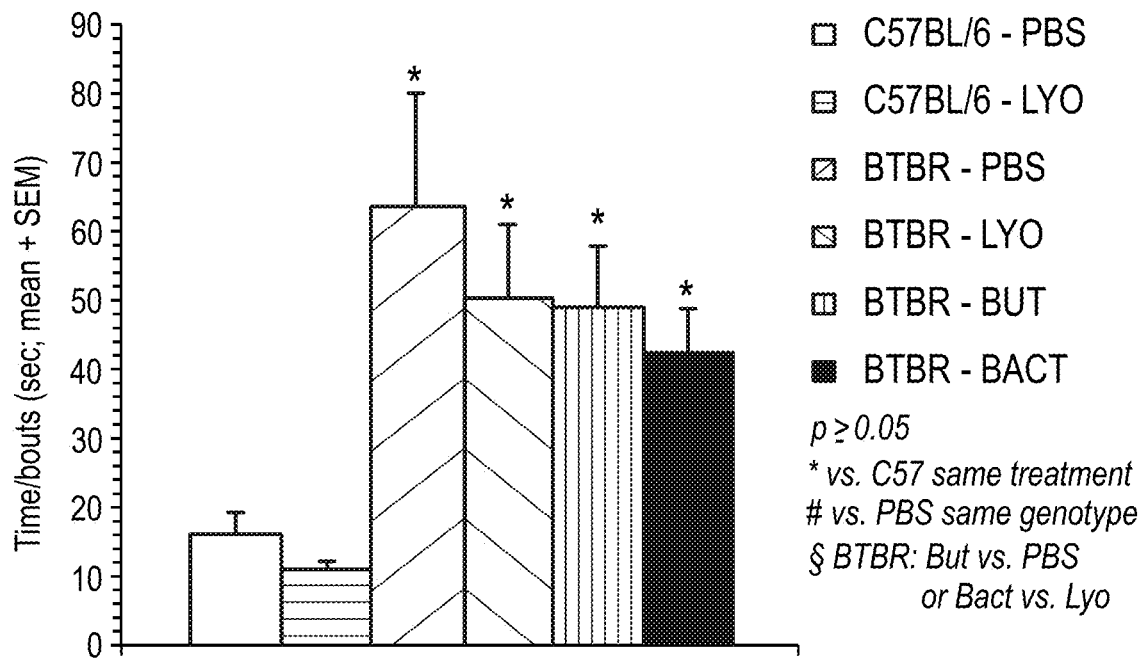
Figure 54F:
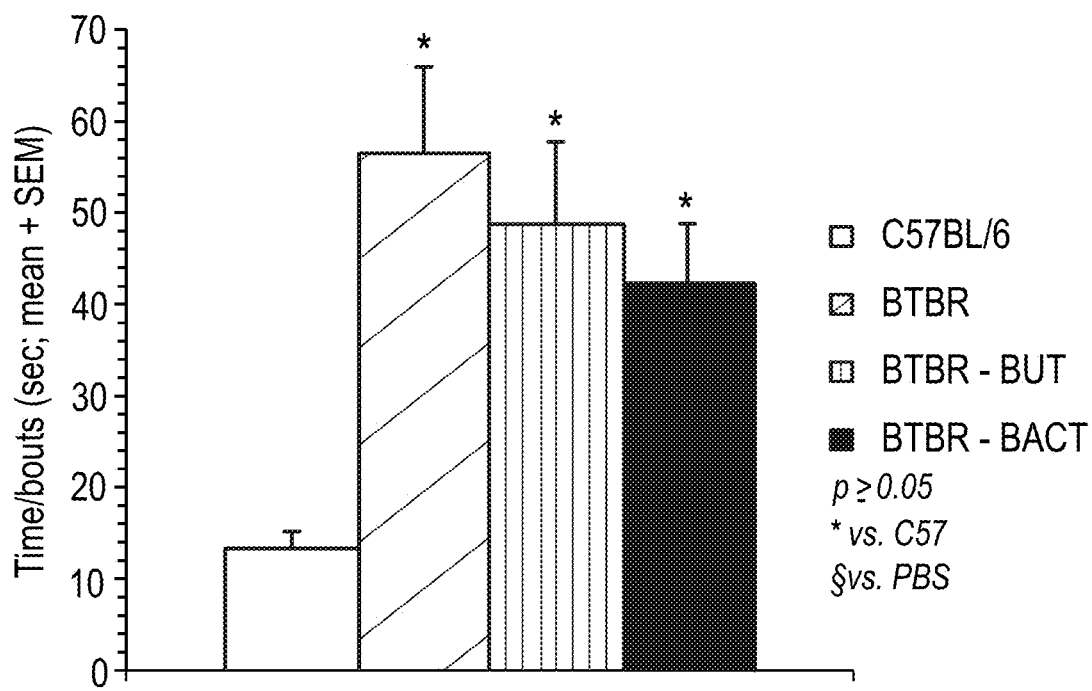

See Example 2e above. PBS is the negative control for the administration of butyrate. LYO is the negative control for the administration of the *Blautia hydrogenotrophica*. After the first analyses (FIGS. 54A, C and E), the values for the negative controls of PBS and LYO in both the C57BL/6 and BTBR models were combined and averaged to provide a simplified comparison in the second analysis (FIGS. 54B, D and F).

Results

In line with the BTBR model for stereotyped behaviours, the BTBR mice showed increased time spent grooming as well as increased numbers of grooming bouts compared to the C57BL/6 mouse model, in both the PBS and LYO controls. Administration of butyrate alone showed a reduction in the time spent grooming, the number of grooming bouts, and the time spent grooming per bout, compared to the PBS control. Administration of the bacterial strain reduced the time spent grooming per grooming bout (FIGS. 54A, C and E).

To provide a further comparison between the controls and the experimental values, as outlined above, the values for the PBS and LYO controls were combined in the second analysis. This second analysis provided similar results to those of the first analysis (FIGS. 54B, D and F).

Conclusion

Administration of butyrate or *Blautia hydrogenotrophica* reduces the amount of time spent grooming per bout of grooming.

Example 11e—Overall Conclusion of the *Blautia hydrogenotrophica* Experiments In the open field arena test, *Blautia hydrogenotrophica* significantly improved the exploratory behaviour of the BTBR mice. Furthermore, this bacterial strain reduced anxiety-like behaviour of these mice. Accordingly, it is clear that administration of this bacteria modulates the behaviour of the BTBR mice which display autism-like characteristics. Therefore, one would expect these bacteria to be useful in the treatment and/or prevention of central nervous system disorders or conditions, including neurodevelopmental and/or a neuropsychiatric disorders or conditions.

Administration of this bacterial strain also appears to reduce the amount of time performing stereotyped behaviour per grooming bout in the self-grooming test.

Example 11f—Overall Conclusion of the Butyrate Experiments

The data from the stereotyped behaviour assays point towards a therapeutic role for butyrate in central nervous system disorders.

The administration of butyrate reduced the number of marbles buried compared to the BTBR control and returned the average number to a level similar to that observed in the C57BL/6 wild-type control mice. In addition, the administration of butyrate alone reduced the overall time spend grooming and number of grooming bouts compared to the BTBR control.

These results provide telling indications regarding a role for butyrate in reducing repetitive and stereotyped behaviours in animal models.

Figure 55:
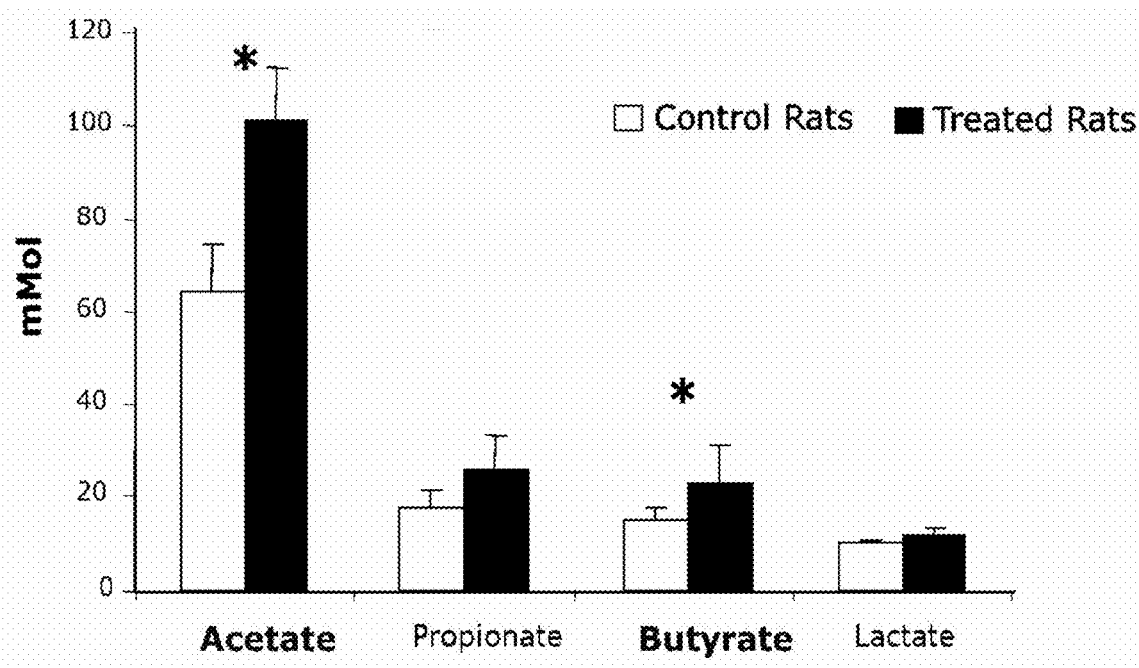
FIG. 55: Effect of *Blautia hydrogenotrophica* ($10^{10}$/day for 14 days) on short chain fatty acids production (RMN $^1$H) in caecal contents of healthy HIM rats.

Example 12—Effects of Bacterial Lyophilisate on SCFA Production Healthy Rats The effects of chronic administration of a lyophilisate of *Blautia hydrogenotrophica* strain DSM 14294 on SCFA production in healthy HIM rats were studied and the results are reported in FIG. 55. Further details regarding the experiments are provided above in the descriptions of the figure. FIG. 55 shows that administration of BH induces a significant increase in acetate as well as in butyrate production.

Example 13—Efficacy of *B. hydrogenotrophica* Studied in Human Microbiota Associated Rat (HMA Rat) Model Summary Groups of 16 germ-free rats (comprising 8 rats in the control group and 8 rats in the treatment group) were inoculated with the faecal microbiota from a human IBS subject (IBS-HMA rats). Three successive experiments were carried out using faecal samples from 3 different IBS patients. Two other groups of rats (n=10) were inoculated with faecal samples of healthy subject (n=2 subjects; 2 groups of healthy-HMA rats) as visceral sensitivity control. Thus, there were 24 IBS-microbiota associated rats (control), 24 IBS microbiota associated rats treated with Blautix and 20 healthy-microbiota associated rats. Half of the IBS-HMA rats were then administered for 28 days with composition comprising the bacterial strain of *B. hydrogenotrophica* according to the invention while the other half animals received a control solution.

Strain

*Blautia hydrogenotrophica* (BH) Strain DSM 14294.

Composition and Administration

BH lyophilisate was suspended in sterile mineral solution to a concentration of $10^{10}$ bacteria per ml. Two ml of this suspension was administered daily per IBS-HMA rat, by oral gavage, for a 28 days period.

The control solution was the sterile mineral solution that was administered daily (2 ml per rat) by oral gavage to the control group of IBS-HMA rats.

Rats

Germ-Free male Fisher rats (aged 10 weeks) were inoculated with human faecal microbiota from an IBS subject (IBS-HMA rats). Sixteen rats were inoculated with the same human faecal inoculum. Three successive experiments were performed with faecal samples from three different IBS subjects. Two other groups of ten rats were inoculated with faecal sample from 2 healthy subjects (normo-sensitivity control groups).

Study Design

Day-14—Inoculation of Germ-free rats with human faecal microbiota.

Days 0 to 28—Daily dose of BH lyophilisate (assay group), or control solution (control group) by oral gavage Between days 14 and 22—operation to implant electrode into the abdomen (for distension assay)

Days 22-28—Adaptation of the rats to avoid stress associated with distension test.

Day 28—distension assay and euthanasia of animals to collect the caecal samples for sulphides and short chain fatty acid (SCFA) analysis.

Days 0, 14 and 28—Collection of faecal samples for microbial analysis: qPCR for evaluating BH population and other commensal groups of miccroorganisms and enumeration of functional groups of microorganisms using selective media and strictly anaerobic method.

Results

Figure 56:
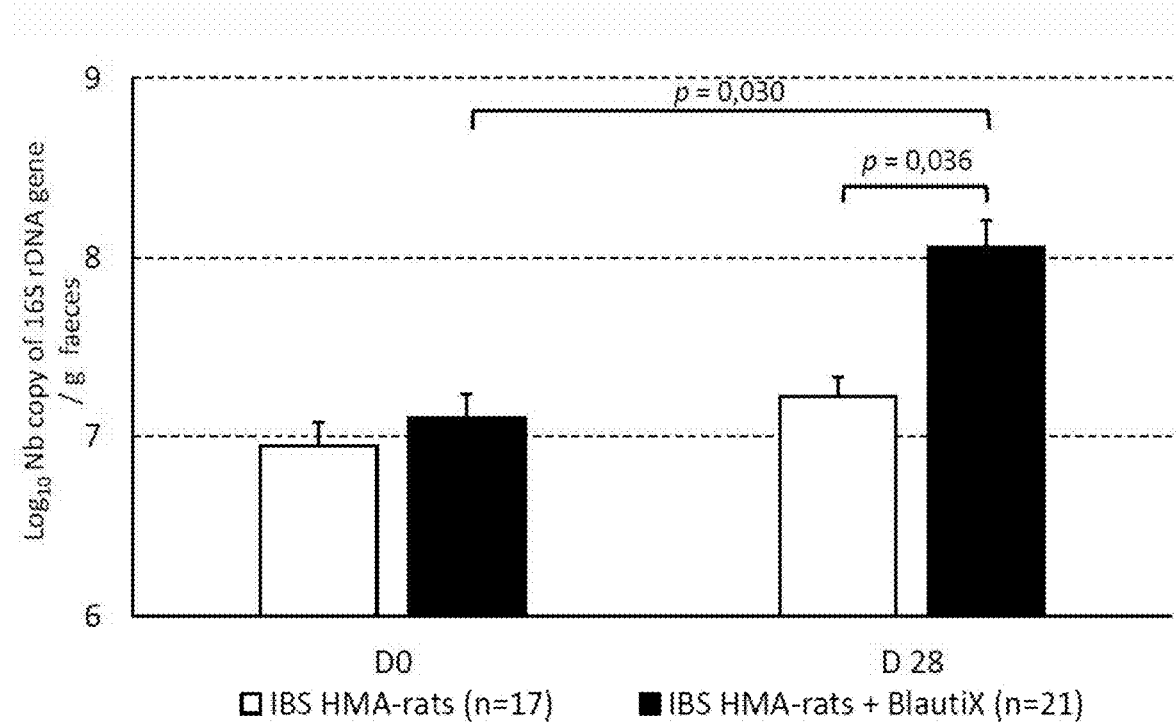
FIG. 56: Qper evaluation of *B. hydrogenotrophica* population in faecal samples of IBS-HMA rats treated or not with a composition comprising *B. hydrogenotrophica* (BlautiX) for 28 days.

FIG. 56 presents the results of qPCR analysis of the *B. hydrogenotrophica* population in faecal samples from IBS-HMA rats receiving control solution or BH lyophilisate. A significant increase in the BH population was observed at the end of the administration period (D 28) in rats receiving the BH lyophilisate, which confirms successful delivery of BH in the colon.

Figure 57A:
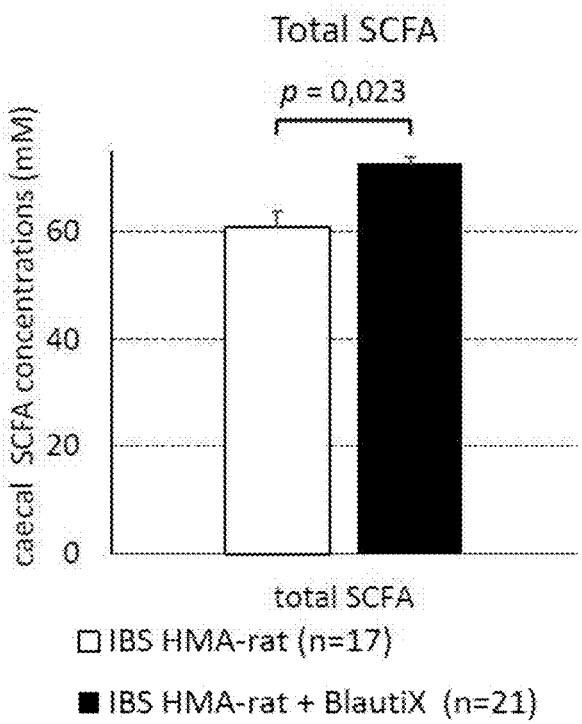
FIGS. 57A-57B: Short chain fatty acids (SCFA) concentrations in caecal samples of IBS-HMA rats treated or not with *B. hydrogenotrophica* (Blautix) for 28 days.
Figure 57B:
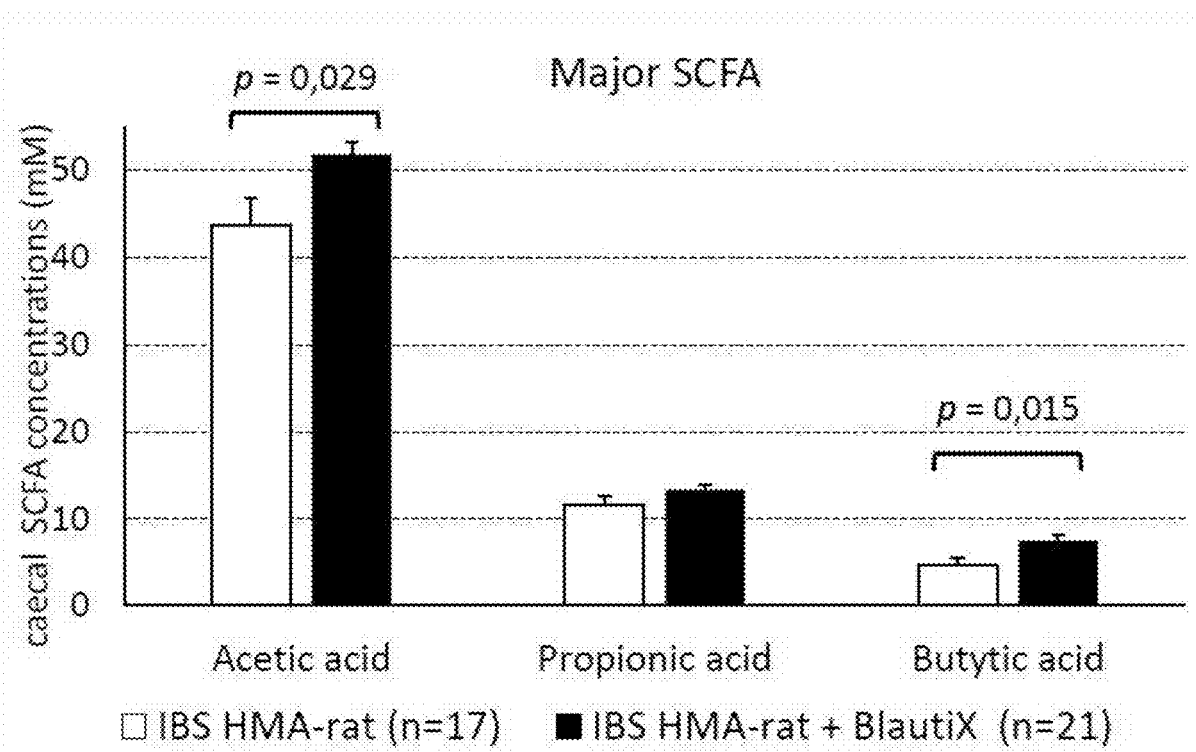

FIG. 57 reports on the impact of administration of BH on the main fermentative metabolites, short chain fatty acids, in caecal samples of IBS-HMA rats. Administration of BH-resulted in a significant increase in acetate concentration as well as in a significant increase in butyrate concentration (FIG. 57B).

Example 14—Assessment of Social Interaction Behaviour in the Three Chamber Test

Rationale and Methods

See Example 1b above. In this experiment, the data recorded is the exploration time, which is defined by the sniffing time of the cylinders (containing an object, a congener) during the first 5-min period and during the 10-min session.

Figure 58A:
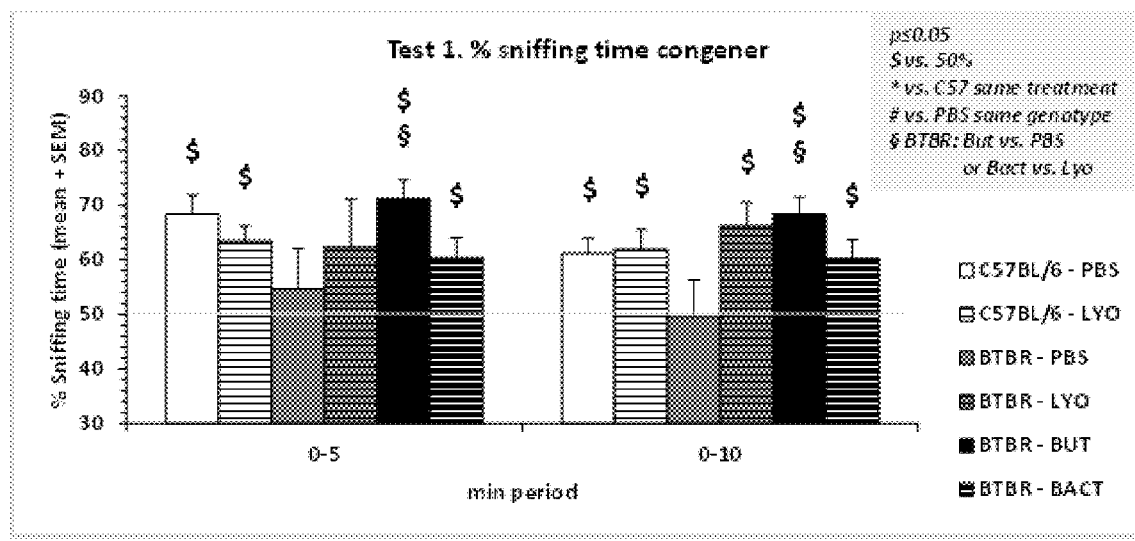
FIGS. 58A-58B: Effect of chronic treatment with *Blautia hydrogenotrophica* and butyrate on BTBR mice in the three chamber test.

Read-Outs:
Test 1, sociability (congener vs. object):
  Index of sociability: % sniffing time of the congener (if >50%: sociability, i.e. preference for the congener vs. the object)
  Other read-outs, indices of exploratory behaviour: exploration time of the congener, the object, total
Test 2, social novelty preference (new congener vs. familiar congener):
  Index of social novelty preference (or aversion): % sniffing time of the new congener
  Other read-outs, indices of exploratory behaviour: exploration time of the new and familiar congeners, total Results Test 1: Sociability (FIG. 58A):

In the C57BL/6 mice the sociability is not different in PBS and in LYO treated mice. As would be expected, BTBR mice showed reduced sociability in the PBS control. Unexpectedly BTBR mice displayed improved sociability when treated with LYO. However, the differences between BTBR-PBS vs. C57-PBS, BTBR-LYO vs. C57-LYO and BTBR-PBS vs. BTBR-LYO are not significant. Interestingly, administration of butyrate improved sociability in BTBR mice (significantly different between BTBR-PBS vs. BTBR-BUT. Administration of *Blautia hydrogenotrophica* increased sociability compared to the bacterial PBS control.

Figure 58B:
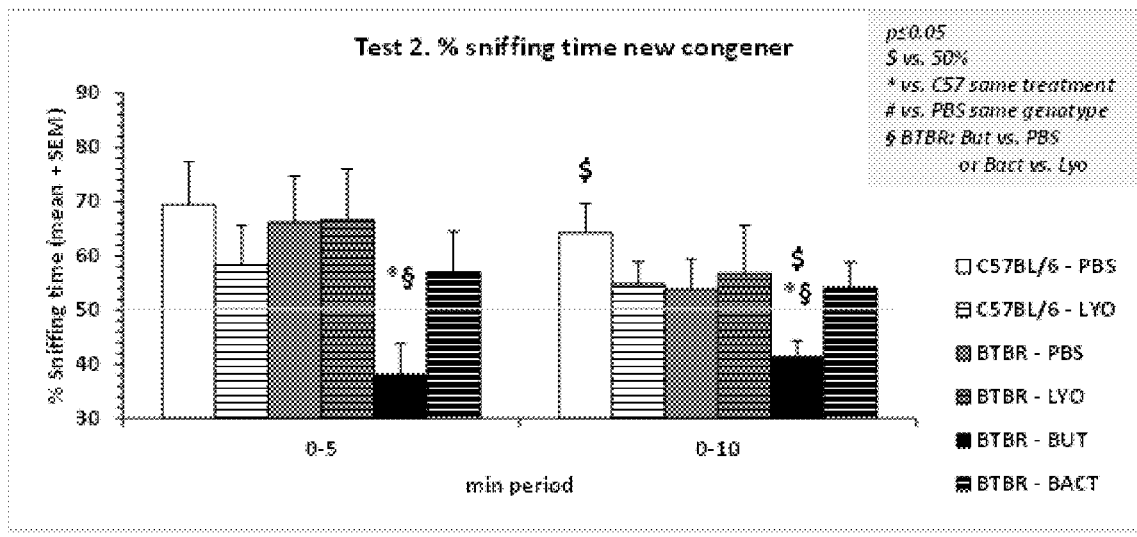

Test 2: Social Novelty (FIG. 58B):

There is a social novelty preference in C57BL/6 mice treated with PBS, but this preference is reduced in C57BL/6 mice administered LYO (these differences are not significant). In the 10 min session, BTBR mice showed reduced social novelty preference compared to C57BL/6 mice when treated with either PBS or LYO. The differences between differences BTBR-PBS vs. C57-PBS, BTBR-LYO vs. C57 LYO and BTBR-PBS vs. BTBR-LYO are not significant. The results shown in FIG. 58B are therefore difficult to interpret.

Overall conclusions regarding *Blautia hydrogenotrophica* in the treatment of autistic spectrum disorders The experiments disclosed herein display evidence that administration of another *Blautia* species (namely *Blautia hydrogenotrophica*) may be applicable for the treatment of neurodevelopmental and neuropsychiatric disorders in mice models. In particular, treatment with *Blautia hydrogenotrophica* reduced anxiety-like, stereotyped and repetitive behaviour, and increased sociability in mice.

The EMA Guidelines on the clinical development of medicinal products for the treatment of autism spectrum disorder state that, due to the heterogeneity of the diseases, it may not be possible to achieve a significant effect on all core symptoms with a single compound, and so short term efficacy has to be demonstrated on at least one core symptom. The *Blautia hydrogenotrophica* live biotherapeutic has shown effective treatment of at least one core symptom of autistic spectrum disorder, so it and related *Blautia* and *B. hydrogenotrophica* strains are expected to be effective against human disease. Similarly, other central nervous system disorders or conditions display complex pathology with multiple different symptoms, and have few approved treatments. Therefore, it is understood that an effective treatment does not need to treat all symptoms of a central nervous system disorder or condition. A treatment would be considered therapeutically useful if it treated one of the symptoms associated with a central nervous system disorder or condition.

Figure 59:
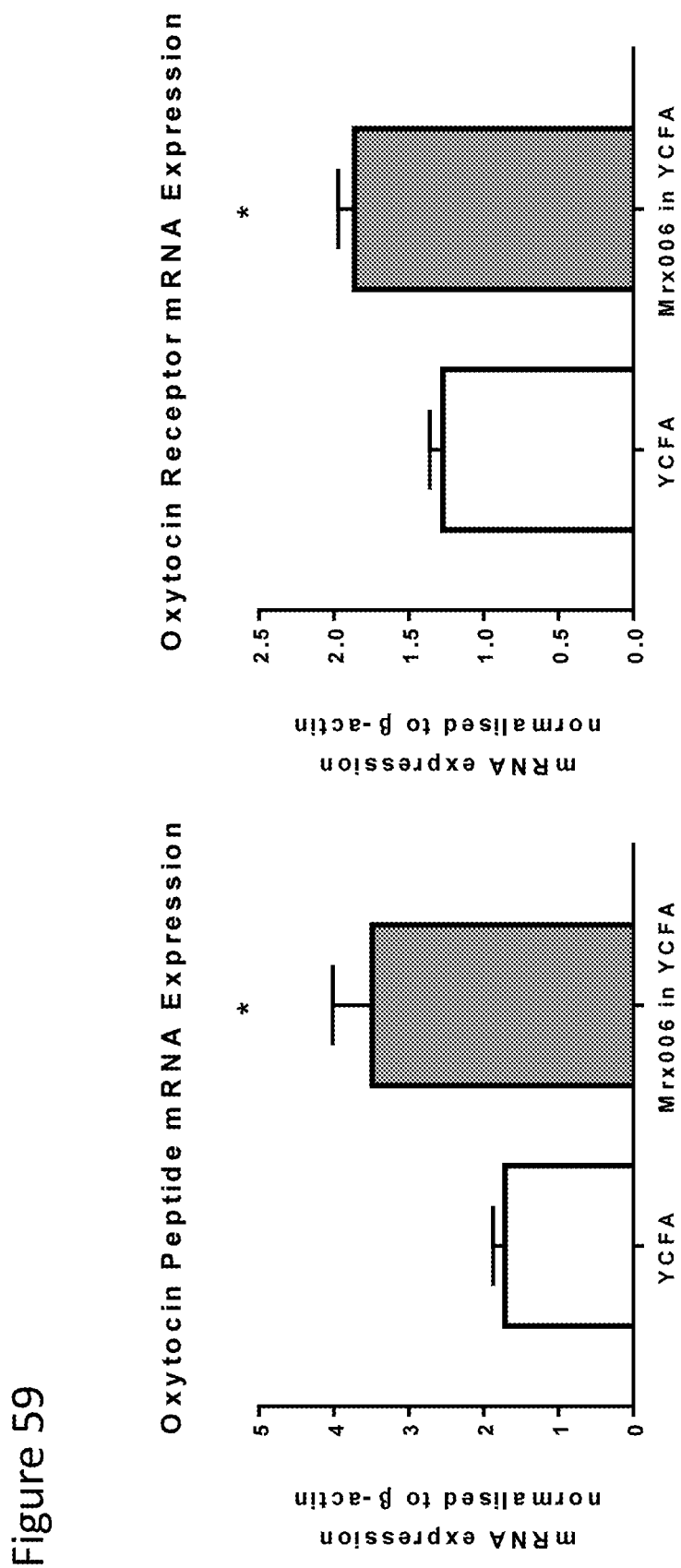
FIG. 59: Effect of chronic treatment with MRX006 on expression of oxytoxin and oxytoxin receptor in the hypothalamic cell lines.

Example 15—Assessing the Effects of Chronic Treatment with MRX006 on Gene Expression Levels of Oxytocin and its Respective Receptors in the Hypothalamic Cell Lines Chronic treatment with MRX006 significantly increases the level of mRNA expression of oxytocin and its receptor in hypothalamic cell lines (FIGS. 59A and B).

This striking result provides a correlation between chemical changes in the brain and behavioural changes upon administration of MRX006. This is the first time any study has reported that a live biotherapeutic is capable of altering the central oxytocin system, with a concurrent change in social, anxiety-like and stereotyped behaviour with an improvement in gastrointestinal function.

Example 16—The BALBc Mouse Model

Example 16a—Materials and Methods for BALBc Mouse Model

Mice

BALBc (Envigo, UK) adult male mice were group housed under a 12 h light-dark cycle (lights on from 7:00-19:00 hr); standard rodent food and water were available ad libitum. All experiments were conducted in accordance with the European Directive 2010/63/EEC, the requirements of S.I. No 543 of 2012, and approved by the Animal Experimentation Ethics Committee of University College Cork. Animals were 8 weeks old at the start of the experiment.

Strain

MRX006: *Blautia stercoris* bacterium deposited under accession number NCIMB 42381.

The bacteria were provided in glycerol stock and grown in the facility in anaerobic conditions.

MRX006 Administration

Animals were allowed to habituate to their holding room for one week after arrival into the animal unit. Dosing with MRX006 or vehicle commenced when the mice were 8 weeks old. MRX006 ($1 \times 10^7$ to $1 \times 10^9$ CFU) was dissolved in PBS prior to administration. The mice received oral gavage (200 μL dose) of MRX006 at a dose of $1 \times 10^9$ CFU for 6 consecutive days between 15:00 and 17:00. On day 7, the animals were decapitated and tissues were harvested for experimentation.

Tissue Collection

Animals were sacrificed in a random fashion regarding treatment and testing condition; sampling occurred between 9.00 a.m. and 2:30 p.m. Trunk blood was collected in potassium EDTA (Ethylene Diamine Tetra Acetic Acid) tubes and spun for 15 min at 4000 g. Plasma was isolated and stored at −80° C. for further analysis. The brain was quickly excised, dissected and each brain region was snap-frozen on dry ice and stored at −80° C. for further analysis. Spleen was removed, collected in 5 mL RPMI media (with L-glutamine and sodium bicarbonate, R8758 Sigma+10% FBS (F7524, Sigma)+1% Pen/Strep (P4333, Sigma)) and processed immediately after culls for ex-vivo immune stimulation. Intestinal tissue (2 cm segments of ileum and colon closest to the caecum were excised, and the furthest lcm of tissue from the caecum were used) were mounted into the Ussing chambers for intestinal permeability assay. A further 1 cm of ileum and colon tissue was taken for tight junction gene expression analysis. The caecum was removed, weighed and stored at −80° C. for SCFAs analysis.

Statistical Analysis

Normally distributed data are presented as mean±SEM; Non-parametric datasets are presented as median with inter-quartile range. Unpaired two-tailed t-test were applied to analyse parametric data and Mann-Whitney test was used for non-parametric. Spearman's rank correlation coefficient was employed for the correlation analysis in the pooled datasets. A p value <0.05 was deemed significant in all cases.

Example 16b—Assessing the Effects of Chronic Treatment with MRX006 on Ex Vivo Gastrointestinal Permeability and Tight Junction Expression Methods Mice were euthanized by cervical dislocation, and the distal ileum and colon were removed, placed in chilled Krebs solution, opened along the mesenteric line and carefully rinsed. Preparations were then placed in Ussing chambers (Harvard Apparatus, Kent, UK, exposed area of 0.12 cm$^2$) as described previously (Hyland and Cox, 2005 [58]) with oxygenated (95% 02, 5% CO2) Krebs buffer maintained at 37° C. 4 kDa FITC-dextran was added to the mucosal chamber at a final concentration of 2.5 mg/mL; 200 µL samples were collected from the serosal chamber every 30 min for the following 3 h.

Results

Using the passage of FITC from the luminal to the serosal side of the Ussing chamber as an index of gut permeability (as described in Example 21), it was determined that MRX006 had no effect on ileum or colon tissue permeability. FIGS. 60A and 61A demonstrate that chronic treatment with MRX006 does not influence the permeability of the colon or ileum.

Figure 60:
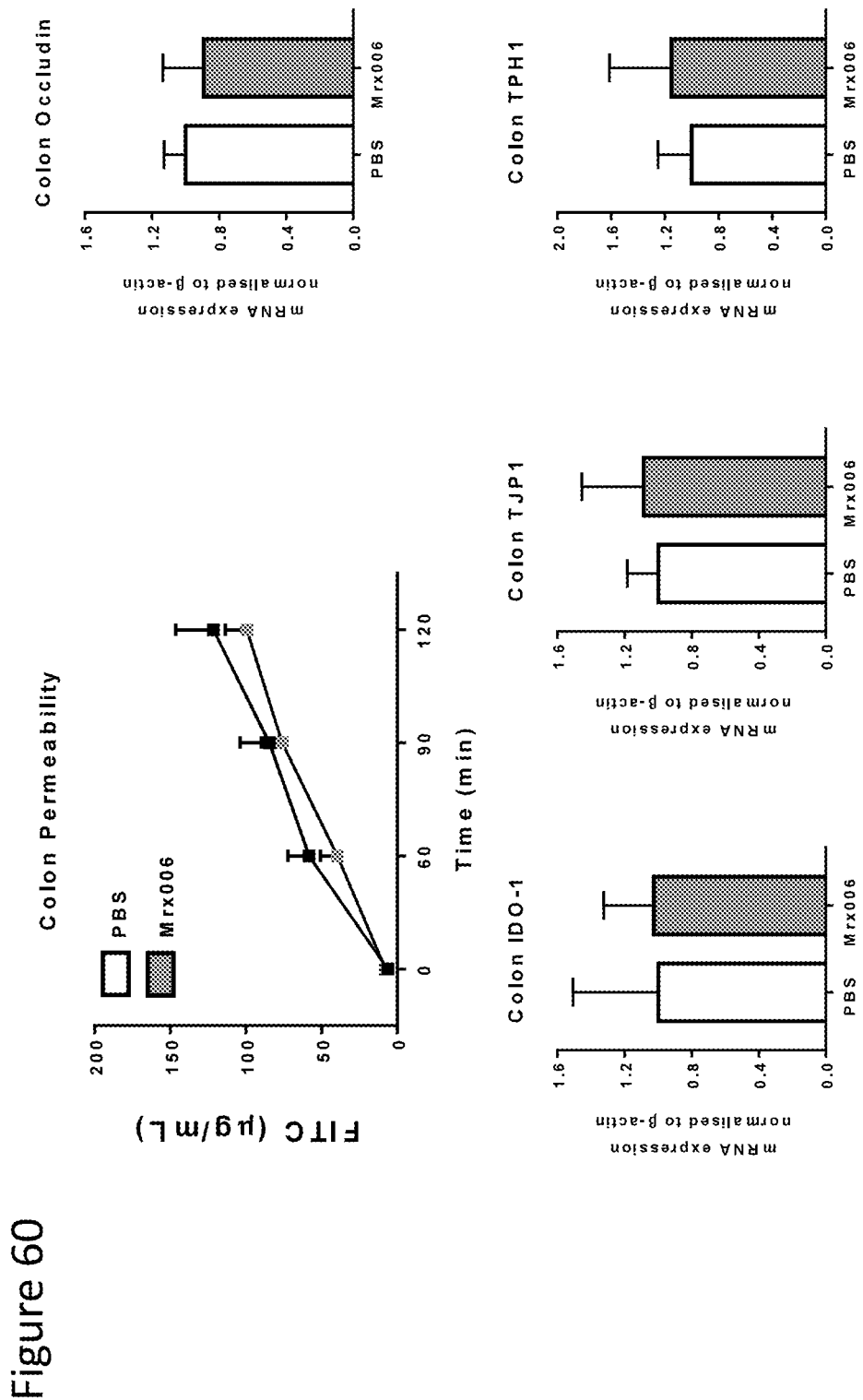
FIG. 60: Effect of chronic treatment with MRX006 on ex vivo gastrointestinal permeability and tight junction expression in colon in BALBc mouse model.
Figure 61:
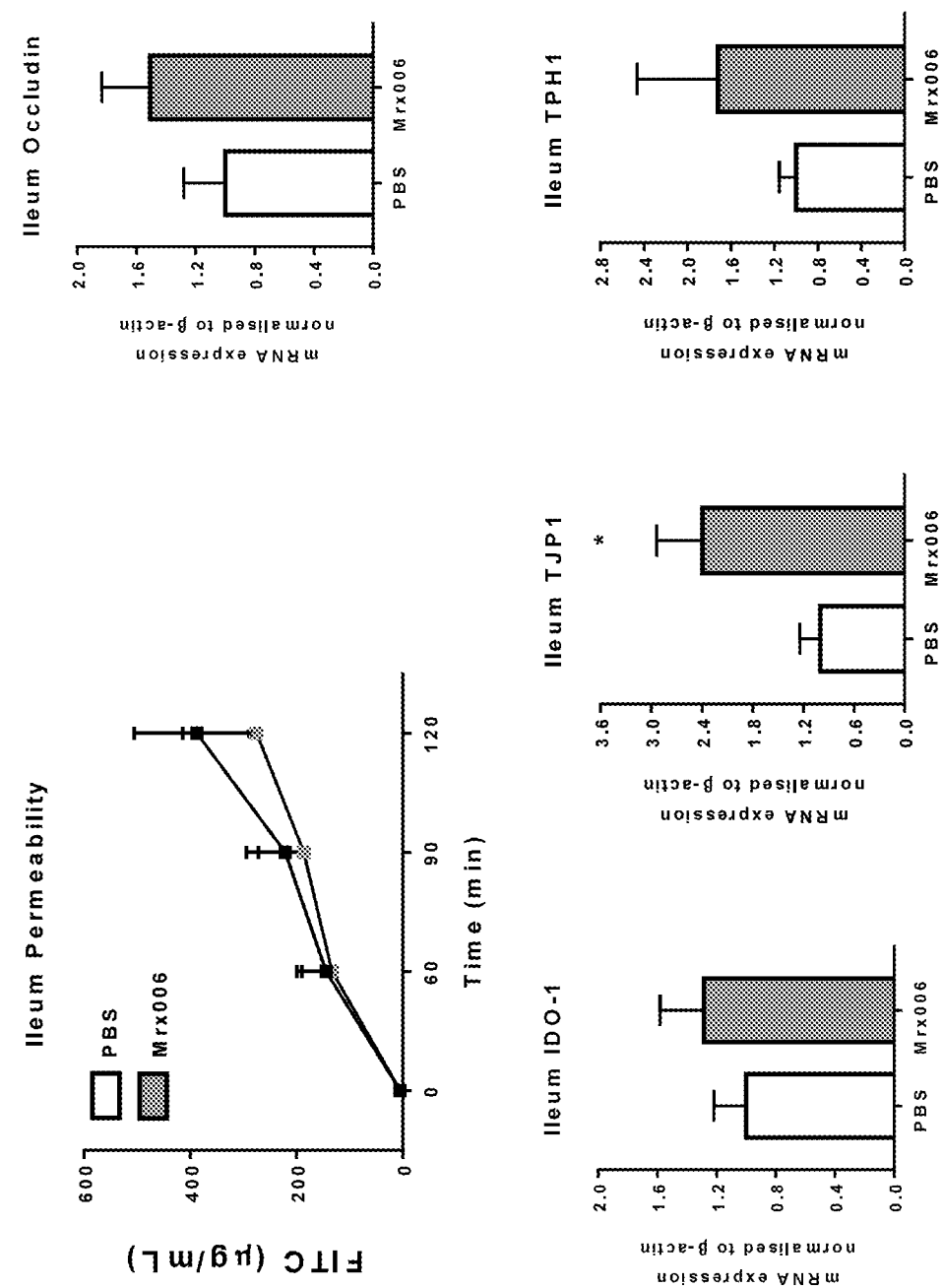
FIG. 61: Effect of chronic treatment with MRX006 on ex vivo gastrointestinal permeability and tight junction expression in ileum in BALBc mouse model.

MRX006 had no effect on mRNA expression of the tight junction protein (involved in maintaining the integrity of the gut barrier) occludin, the enzyme IDO-1 (Indoleamine-pyrrole 2,3-dioxygenase-1 the first and rate-limiting enzyme in the tryptophan/kynurenine pathway), nor TPH1 (Tryptophan hydroxylase 1, an isoform of the enzyme tryptophan hydroxylase, responsible for the synthesis of serotonin) in ileum or colon tissue (FIGS. 60 and 61 B, C and E). MRX006 did however increase TJP-1 (Tight Junction Protein 1, a tight junction protein) mRNA expression in the ileum, but not the colon (FIGS. 60D and 61D).

Discussion

MRX006 had no effect on ileum or colon permeability, but did increase TJP1 expression. TJP1 is one of a number of tight junction proteins associated with maintaining gut integrity, and while we did see this increase in mRNA expression, this may not necessarily reflect the protein expression of this tight junction nor its incorporation into the endothelium. The finding that the 6 day treatment with MRX006 does not alter permeability suggests that it does not negatively impact on gut permeability and integrity. MRX006 also did not alter IDO-1 nor TPH1 suggesting that it does not alter serotonin production nor the tryptophan/kynurenine pathway in the gut.

These data demonstrate that chronic treatment with MRX006 does not alter the gut permeability and does not affect the integrity of the gut barrier. This shows that the ability of MRX006 attenuate stereotyped and anxiety-related behaviours does not lead to a deficiency in the gut barrier integrity.

Example 16c—Assessing the Effects of Chronic Treatment with MRX006 on Caecal Short Chain Fatty Acid Production Methods Caecum content was mixed and vortexed with MilliQ water and incubated at room temperature for 10 min. Supernatants were obtained by centrifugation (10000 g, 5 min, 4° C.) to pellet bacteria and other solids and filtration by 0.2 µm. It was transferred to a clear GC vial and 2-Ethylbutyric acid (Sigma) was used as the internal standard. The concentration of SCFA was analyzed using a Varian 3500 GC flame-ionization system, fitted with a with a ZB-FFAP column (30 m×0.32 mm×0.25 mm; Phenomenex). A standard curve was built with different concentrations of a standard mix containing acetate, propionate, iso-butyrate, n-butyrate, isovalerate and valerate (Sigma). Peaks were integrated by using the Varian Star Chromatography Workstation version 6.0 software. All SCFA data are expressed as µmol/g.

Results

Figure 62:
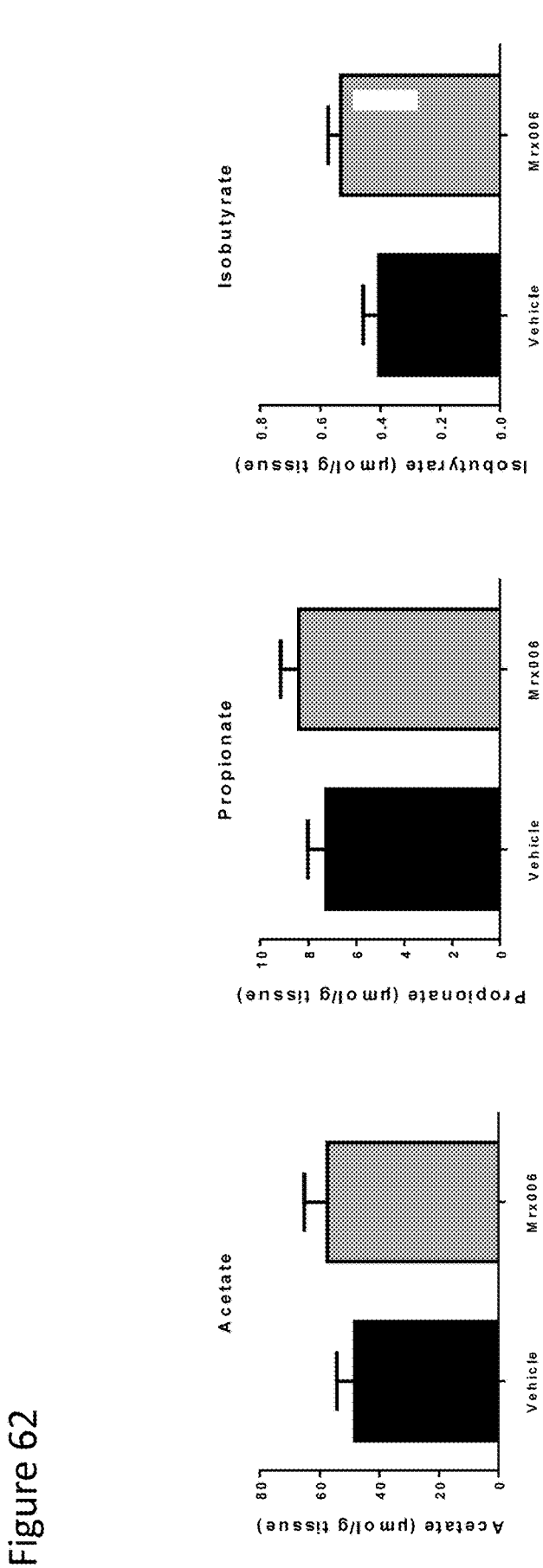
FIG. 62: Effect of chronic treatment with MRX006 on caecal short chain fatty acid production in BALBc mouse model.
Figure 62:
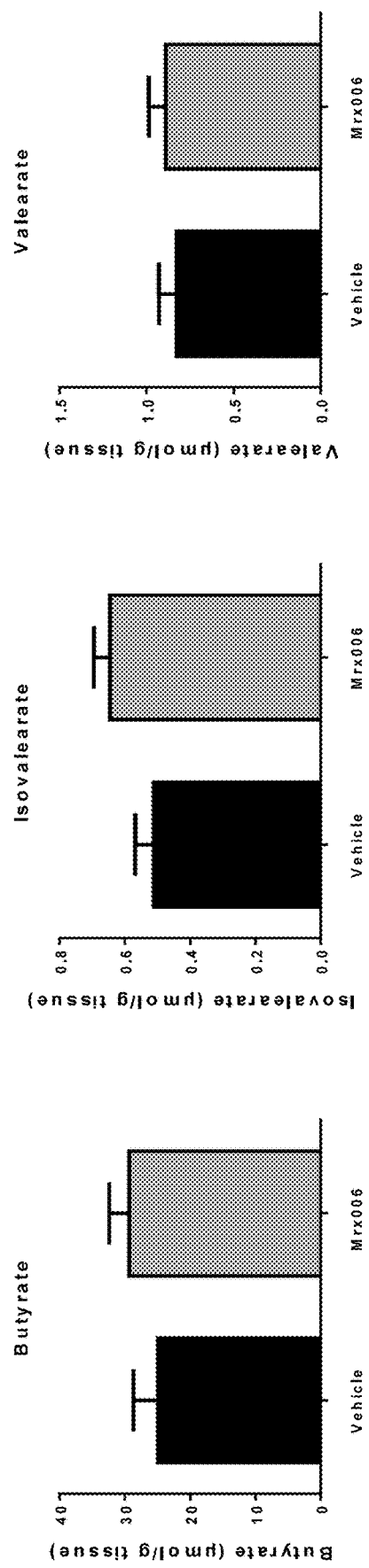

Short chain fatty acids (SCFAs) are produced when non-digestible fibres from the diet are fermented by bacteria in the gut. 6 days of MRX006 administration had no effect on acetate (t12=0.959, p=0.357), propionate (t12=1.033, p=0.322), isobutyrate (t12=1.859, p=0.090), butyrate (t12=0.857, p=0.408), isovalearate (t12=1.757, p=0.107) or valearate (t12=0.434, p=0.672), when compared to vehicle PBS administration (FIG. 62).

Discussion

The administration of MRX006 had no effect on caecal SCFA production. This suggests that the 6 day regime of MRX006 did not alter the fermentation, or the bacteria responsible for the fermentation of non-digestible fibres from the diet.

Example 16d—Assessing the Effects of Chronic Treatment with MRX006 on Cytokine Expression from Splenocytes Rationale/Methods The ex-vivo splenocyte assay involves challenging the splenocytes (cells isolated from the spleen—a main organ involved in immune defense), with a bacterio- or viral-mimetic challenge.

Spleens were collected immediately in 5 mL RPMI media following sacrifice and cultured immediately. Spleen cells were first homogenised in the RPMI media. The homogenate step was followed by RBC lysis step where the cells were incubated for 5 mins in 1 ml of RBC lysis buffer (11814389001 ROCHE, Sigma). 10 ml of the media was added to stop the lysis and followed by 200 g centrifugation for 5 mins. This was followed by final step where the cells were passed through 40 um strainer. The homogenate was then filtered over a 40 um strainer, centrifuged at 200 g for 5 min and resuspended in media. Cells were counted and seeded (4,000,000/mL media). After 2.5 h of adaptation, cells were stimulated with lipopolysaccharide (LPS-2 µg/ml) or concanavalin A (ConA-2.5 µg/ml) for 24 h. Following stimulation, the supernatants were harvested to assess the cytokine release using Proinflammatory Panel 1 (mouse) V-PLEX Kit (Meso Scale Discovery, Maryland, USA) for TNFα, IL-10, IL-1β, Interferon γ, CXCL2 and IL6. The analyses were performed using MESO QuickPlex SQ 120, SECTOR Imager 2400, SECTOR Imager 6000, SECTOR S 600.

Results

Figure 63:
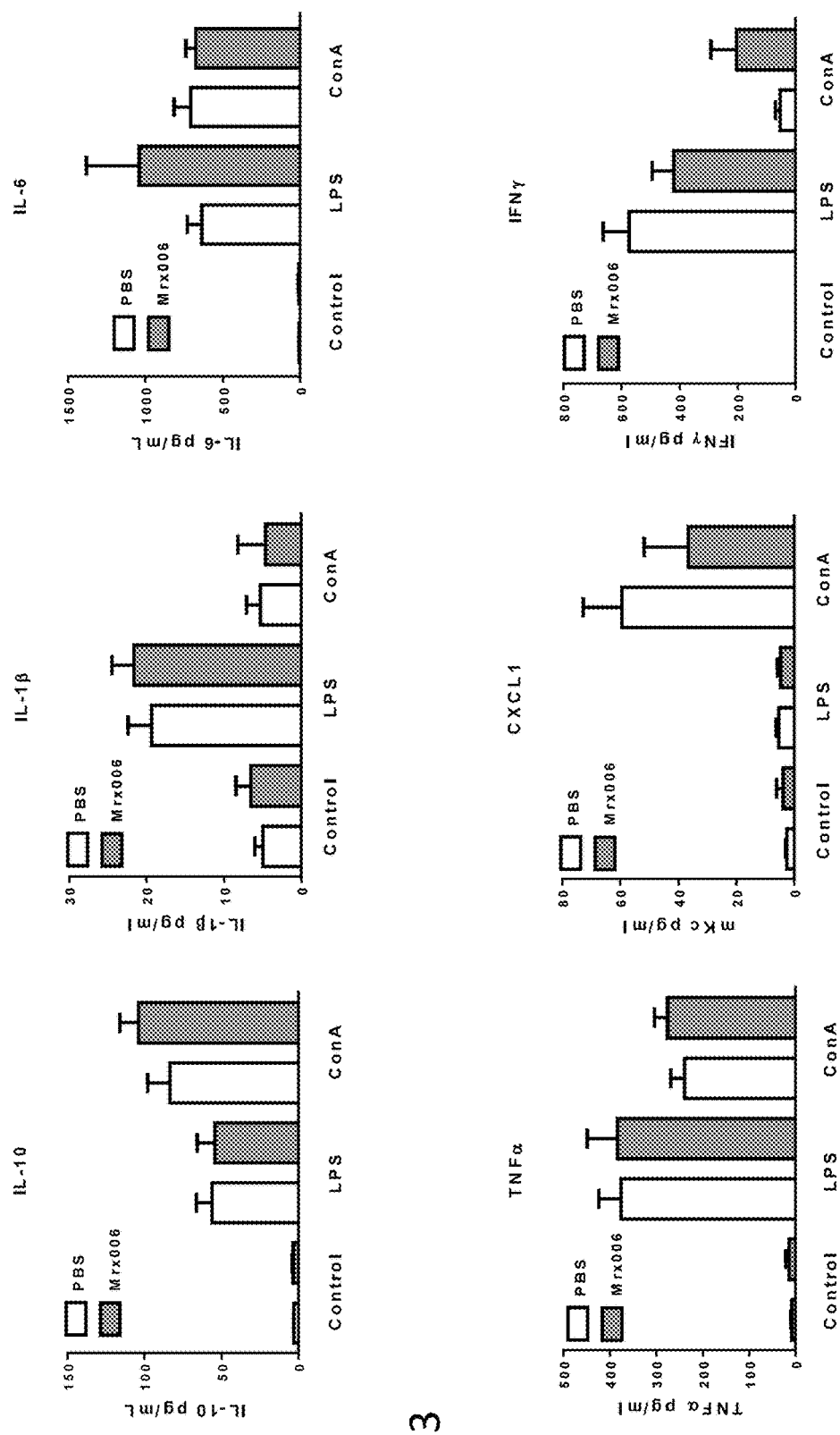
FIG. 63: Effect of chronic treatment with MRX006 on cytokine expression from splenocytes in BALBc mouse model.
Figure 64:
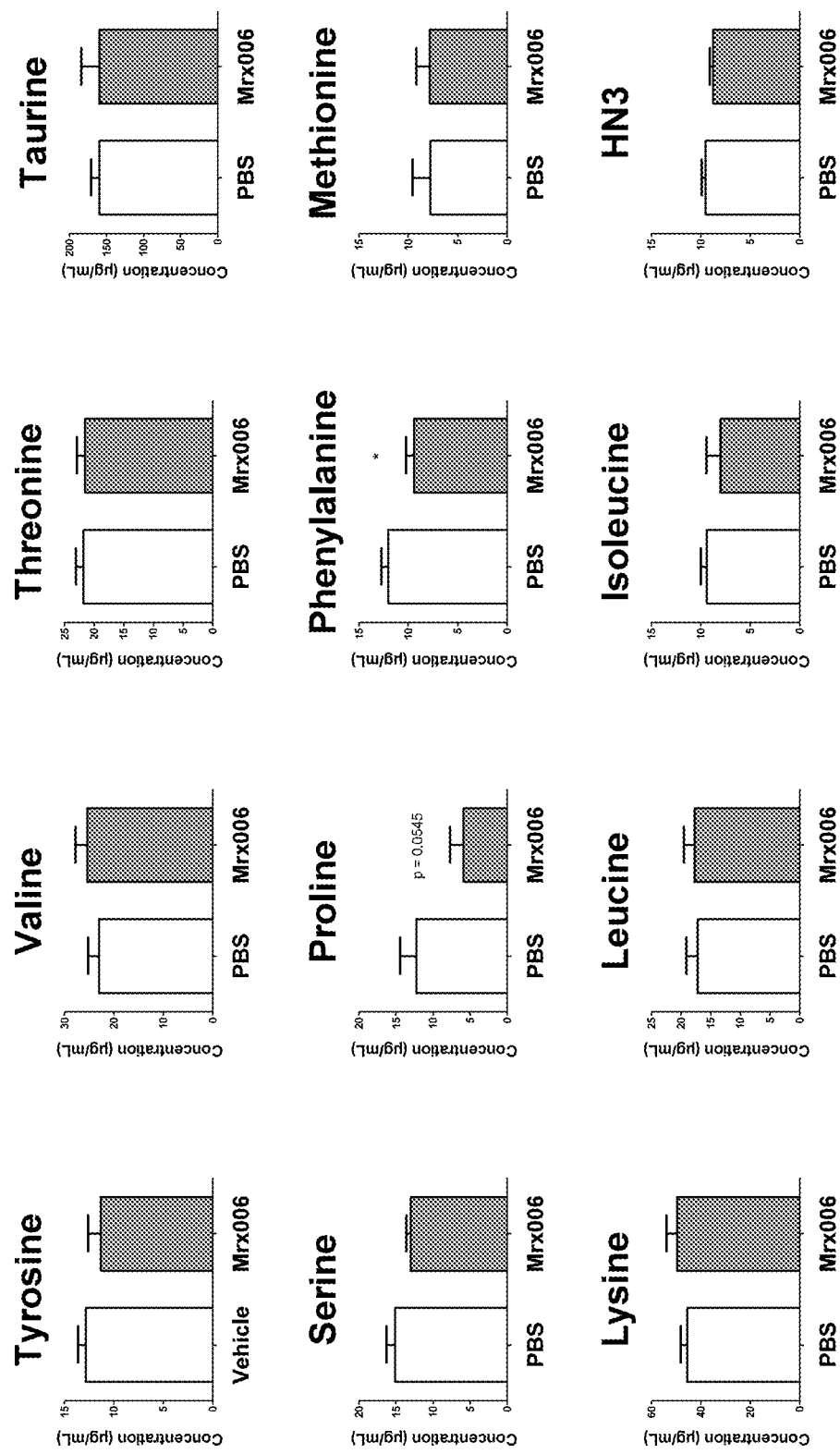
FIG. 64: Effect of chronic treatment with MRX006 on plasma levels of amino acids in BALBc mouse model.
Figure 64:
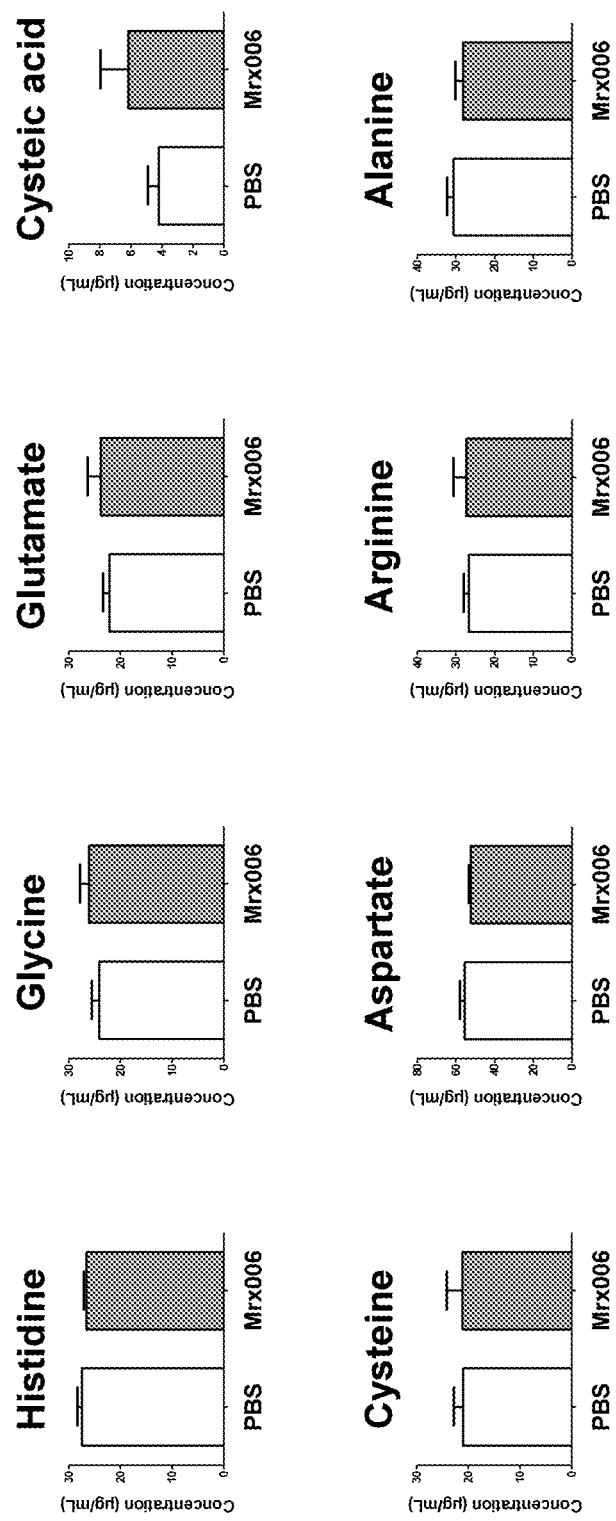

MRX006 had no effect on splenocyte release of proinflammatory (IFNγ, TNFα, IL-1β) nor anti-inflammatory (IL-10, IL-6) or CXCL1 (marker of immune response activation) in response to LPS (mimicking a bacterial infection) or concavalin A (mimicking a viral infection) stimulation (FIG. 63).

Discussion

MRX006 also had no effect on cytokine expression from splenocytes following a challenge with LPS or Concavalin A. This demonstrates that the 6-day MRX006 administration did not negatively influence the innate peripheral immune response. This shows that MRX006 treatment does not activate the systemic immune activation.

Example 16e—Assessing the Effects of Chronic Treatment with MRX006 on Plasma Levels of Amino Acids Rationale and Methods At the end of the experiment trunk blood was collected for amino acid analysis in the plasma. This would give an index of the biosynthesis and catabolism of essential amino acids by changes in microbiota.

Animals were sacrificed in a random fashion regarding treatment and testing condition; sampling occurred between 9.00 a.m. and 2:30 p.m. Trunk blood was collected in potassium EDTA (Ethylene Diamine Tetra Acetic Acid) tubes and spun for 15 min at 4000 g. Plasma was isolated and stored at −80° C. for further analysis. Plasma was diluted with 0.2 mol/L sodium citrate buffer, pH 2.2 to yield 250 nmol of each amino acid residue. Samples were diluted with the internal standard norleucine, to give a final concentration of 125 nm/mL. Amino acids were quantified using a Jeol JLC-500/V amino acid analyser (Jeol Ltd, Garden City, Herts, UK) fitted with a Jeol Na+ high performance cation exchange column.

Results

MRX006 decreased proline and phenylalanine levels in the plasma.

Discussion

Plasma levels of amino acids were largely unaltered following 6 day administration of MRX006. There are nine essential amino acids that cannot be synthesised de novo and must be supplied directly in the diet or by breakdown of the diet. These include valine, phenylalanine, threonine, tryptophan, methionine, leucine, isoleucine, lysine, and histidine. Six other amino acids are considered conditionally essential in the human diet, meaning their synthesis can be limited under special pathophysiological conditions, such as prematurity in the infant or individuals in severe catabolic distress. These six amino acids include arginine, cysteine, glycine, glutamine, proline, and tyrosine. Five amino acids are dispensable in humans, meaning they can be synthesized in sufficient quantities in the body. These five are alanine, aspartic acid, asparagine, glutamic acid and serine.

In this study the essential amino acid phenylalanine, and proline another important amino acid were decreased following MRX006 administration, suggesting that this probiotic may play a role in metabolism of key amino acids from the diet.

Example 16f—Assessing the Effects of Chronic Treatment with MRX006 on Neurotransmitter Levels in the Brainstem Methods Neurotransmitter concentration was analysed by HPLC on samples from the brainstem. Briefly, brainstem tissue was sonicated in 500 µl of chilled mobile phase spiked with 4 ng/40 µl of N-Methyl 5-HT (Sigma Chemical Co., UK) as internal standard. The mobile phase contained 0.1 M citric acid, 5.6 mM octane-1-sulphonic acid (Sigma), 0.1 M sodium dihydrogen phosphate, 0.01 mM EDTA (Alkem/Reagecon, Cork) and 9% (v/v) methanol (Alkem/Reagecon), and was adjusted to pH 2.8 using 4 N sodium hydroxide (Alkem/Reagecon). Homogenates were then centrifuged for 15 min at 22,000×g at 4° C. and 40 µl of the supernatant injected onto the HPLC system which consisted of a SCL 10-Avp system controller, LECD 6A electrochemical detector (Shimadzu), a LC-10AS pump, a CTO-10A oven, a SIL-10A autoinjector (with sample cooler maintained at 40 C) and an online Gastorr Degasser (ISS, UK). A reverse-phase column (Kinetex 2.6 u C18 100×4.6 mm, Phenomenex) maintained at 30° C. was employed in the separation (Flow rate 0.9 ml/min). The glassy carbon working electrode combined with an Ag/AgCl reference electrode (Shimdazu) operated a +0.8 V and the chromatograms generated were analyzed using Class-VP 5 software (Shimadzu). The neurotransmitters were identified by their characteristic retention times as determined by standard injections, which run at regular intervals during the sample analysis. The ratios of peak heights of analyte versus internal standard were measured and compared with standard injection. Results were expressed as ng of neurotransmitter per g fresh weight of tissue.

Figure 65:
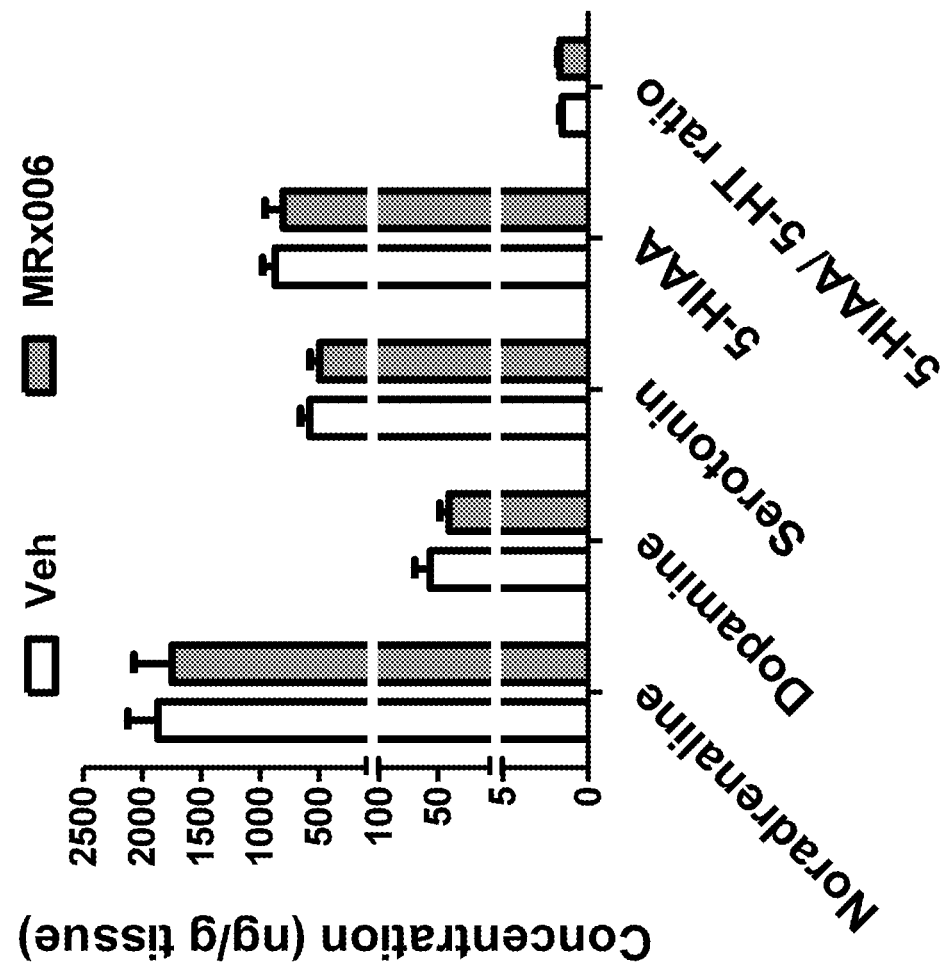
FIG. 65: Effect of chronic treatment with MRX006 on neurotransmitter levels in the brainstem in BALBc mouse model.

Results 6 days administration of MRX006 had no effect on levels of noradrenaline, dopamine, serotonin, 5-HIAA (5-hydroxyindole-acetic acid; a metabolite of 5-HT (5-hydroxy-tryptamine (serotonin)), or serotonin turnover (the ratio of 5-HIAA:5-HT) as determined by unpaired 2-tailed t-test (FIG. 65). Noradrenaline (t12=0.307, p=0.764), dopamine (t12=0.957, p=0.357), serotonin (t12=0.745, p=0.074), 5-HIAA (t12=0.379, p=0.711) levels or serotonin turnover in brainstem (t12=0.683, p=0.507).

Discussion

Neurotransmitter levels in the brainstem were unaltered following 6-day MRX006 administration. These data suggest that MRX006 does not negatively impact on behaviours that are governed by monoamine levels at the level of the brainstem.

Example 16g—Assessing the Effects of Chronic Treatment with MRX006 on Central and Gastrointestinal Gene Expression Rationale Expression of genes for neurotransmitter receptors [serotonin receptor 1a(5-HT1a), dopamine D1 receptor, $GABA_B$ receptor subunit B1, $GABA_A$ receptor, NMDA2A and NMDA2B receptor], inflammatory markers [IL-1β, IL6, CD11b, TNFα and TLR4], and endocrine markers [corticosterone releasing factor (CRF), corticosterone releasing factor receptors 1 and 2 (CRFR1, CRFR2), brain-derived neurotrophin factor (BDNF), vasopressin receptor, oxytocin receptor, glucocorticoid receptor and mineralocorticoid receptor] were analysed in brain tissue from the amygdala, prefrontal cortex and hippocampus.

Methods

Total RNA was extracted using the mirVana™ miRNA Isolation kit (Ambion/Llife technologies, Paisley, UK) and DNase treated (Turbo DNA-free, Ambion/life technologies) according to the manufacturers recommendations. RNA was quantified using NanoDrop™ spectrophotometer (Thermo Fisher Scientific Inc., Wilmington, Del., USA) according to the manufacturer's instructions. RNA quality was assessed using the Agilent Bioanalyzer (Agilent, Stockport, UK) according to the manufacturer's procedure and an RNA integrity number (RIN) was calculated. RNA with RIN value >7 was used for subsequent experiments. RNA was reverse transcribed to cDNA using the Applied Biosystems High Capacity cDNA kit (Applied Biosystems, Warrington, UK) according to manufacturer's instructions. Briefly, Multiscribe Reverse Transcriptase (50 U/μL) (1)(2)(1)(10) was added as part of RT master mix, incubated for 25° C. for 10 min, 37° C. for 2 h, 85° C. for 5 min and stored at 4° C. Quantitative PCR was carried out using probes (6 carboxy fluorescein-FAM) designed by Applied Biosystems to mouse specific targeted genes, while using β-actin as an endogenous control. Amplification reactions contained 1 μl cDNA, 5 μl of the 2× PCR Master mix (Roche), 900 nM of each primer and were brought to a total of 10 μl by the addition of RNase-free water. All reactions were performed in triplicate using 96-well plates on the LightCycler®480 System. Thermal cycling conditions were as recommended by the manufacturer (Roche) for 55 cycles. To check for amplicon contamination, each run contained no template controls in triplicate for each probe used. Cycle threshold (Ct) values were recorded. Data was normalized using β-actin and transformed using the 2-ΔΔCT method and presented as a fold change vs. control group.

Results

Figure 66:
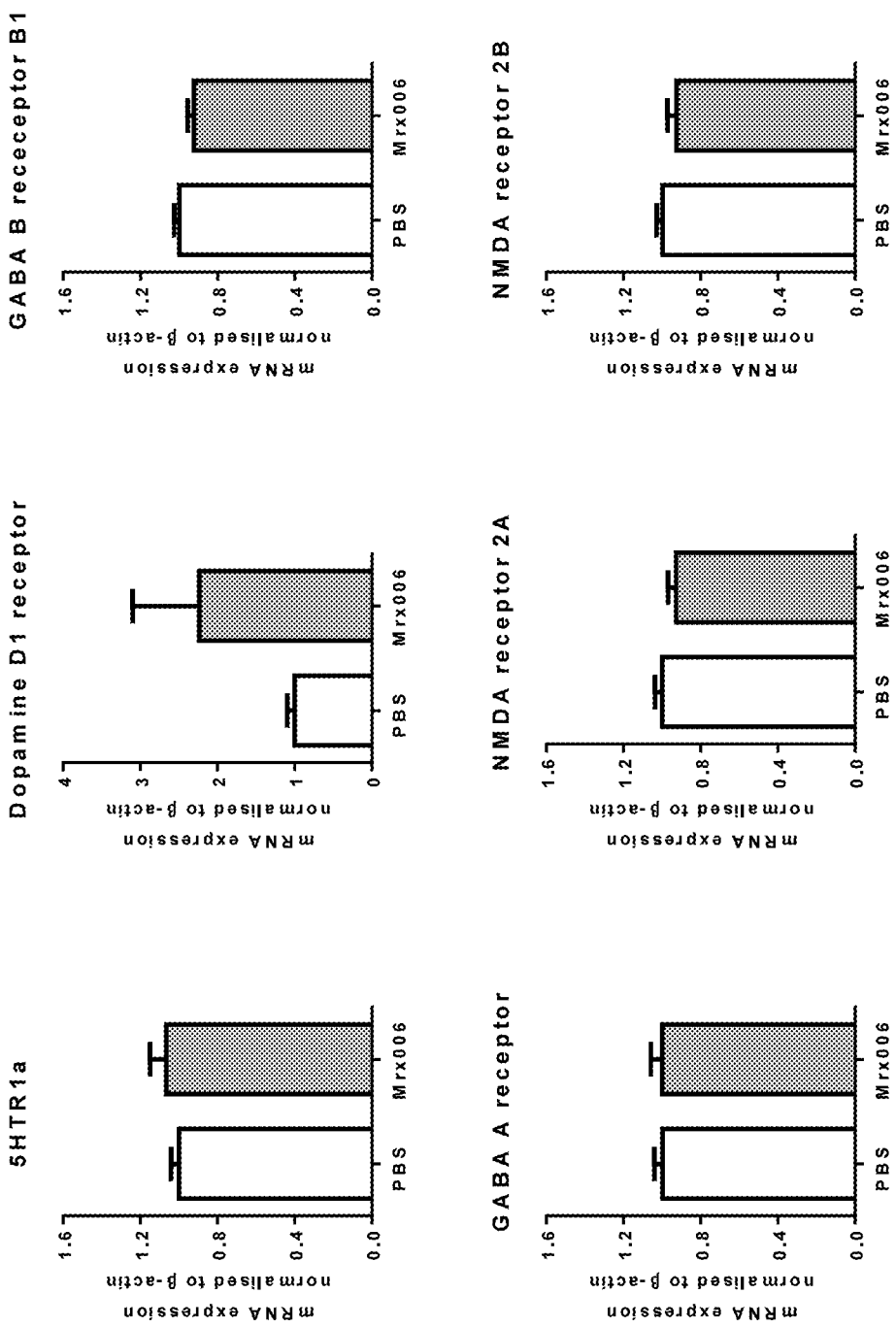
FIG. 66: Effect of chronic treatment with MRX006 on gene expression of hippocampus neurotransmitter receptors in BALBc mouse model.

FIG. 66 shows that MRX006 had no effect on hippocampal gene expression of the neurotransmitter receptors serotonin 1a (5-HT1a) ($t_{11}$=0.742, p=0.474), dopamine D1 receptor ($t_{10}$=1.426, p=0.184), $GABA_B$ receptor B1 subunit ($t_{12}$=1.871, p=0.086), $GABA_A$ receptor ($t_{12}$=0.017, p=0.987), NMDA receptor subunit 2A ($t_{11}$=1.275, p=0.229), NMDA receptor subunit 2B ($t_{11}$=1.39, p=0.192).

Figure 67:
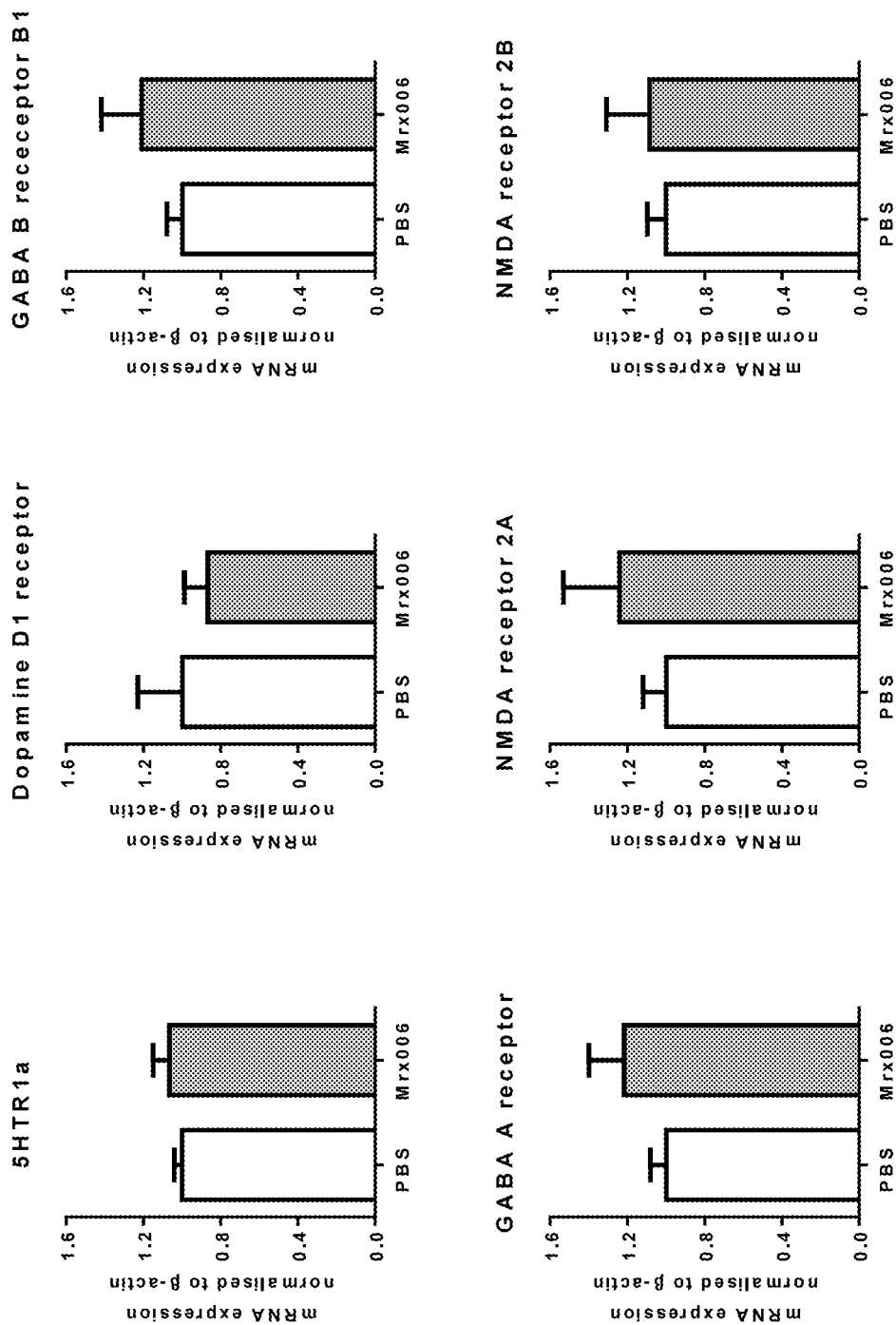
FIG. 67: Effect of chronic treatment with MRX006 on gene expression of amygdalar neurotransmitter receptors in BALBc mouse model.

FIG. 67 shows that MRX006 had no effect on amygdalar gene expression of the neurotransmitter receptors dopamine D1 receptor ($t_{11}$=0.429, p=0.677), $GABA_B$ receptor B1 subunit ($t_{11}$=0.998, p=0.344), $GABA_A$ receptor ($t_{11}$=1.145, p=0.277), NMDA receptor subunit 2A ($t_{12}$=0.852, p=0.411), NMDA receptor subunit 2B ($t_{12}$=0.395, p=0.707).

Figure 68:
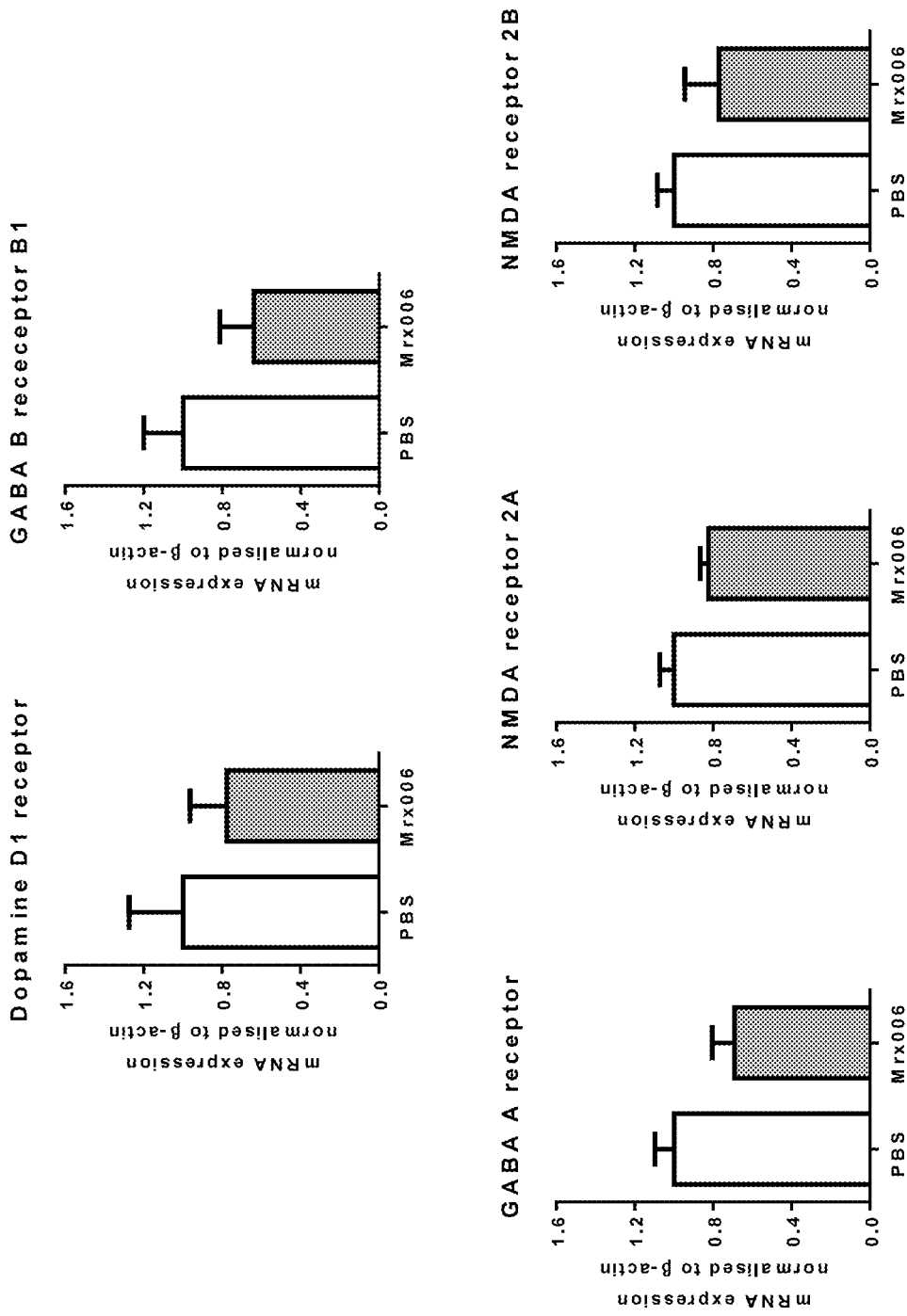
FIG. 68: Effect of chronic treatment with MRX006 on gene expression of prefrontal cortex neurotransmitter receptors in BALBc mouse model.

FIG. 68 shows that MRX006 had no effect on prefrontal cortex gene expression of the neurotransmitter receptors dopamine D1 receptor ($t_{11}$=0.583, p=0.571), $GABA_B$ receptor B1 subunit ($t_{12}$=1.304, p=0.217), $GABA_A$ receptor ($t_{10}$=2.043, p=0.068), NMDA receptor subunit 2A ($t_{11}$=0.177, p=0.104), NMDA receptor subunit 2B ($t_{11}$=1.235, p=0.243).

There was no effect of MRX006 on mRNA expression of neurotransmitter receptors in any of the brain regions investigated (FIGS. 66-68).

Figure 69:
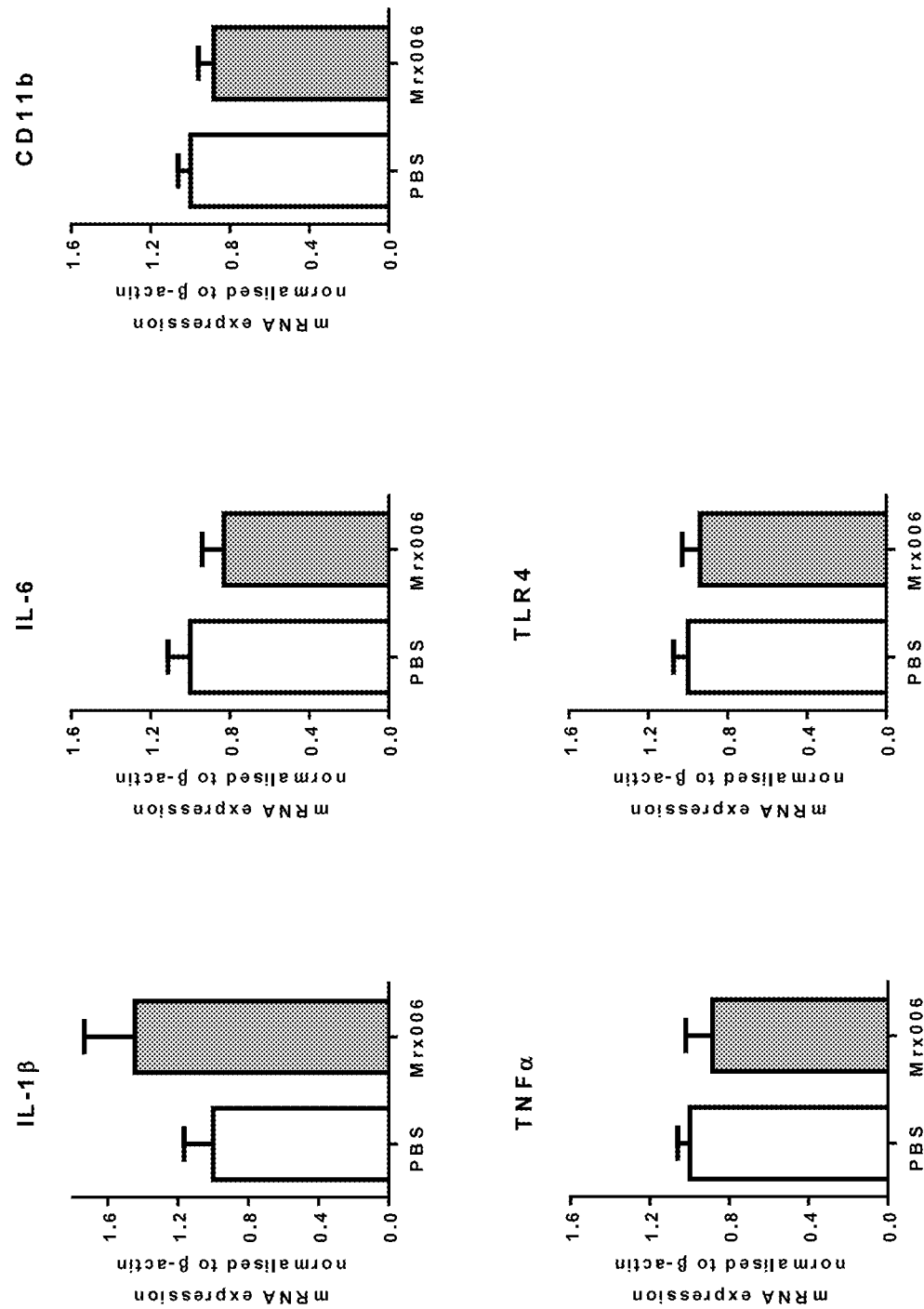
FIG. 69: Effect of chronic treatment with MRX006 on gene expression of inflammatory markers in the hippocampus in BALBc mouse model.
Figure 70:
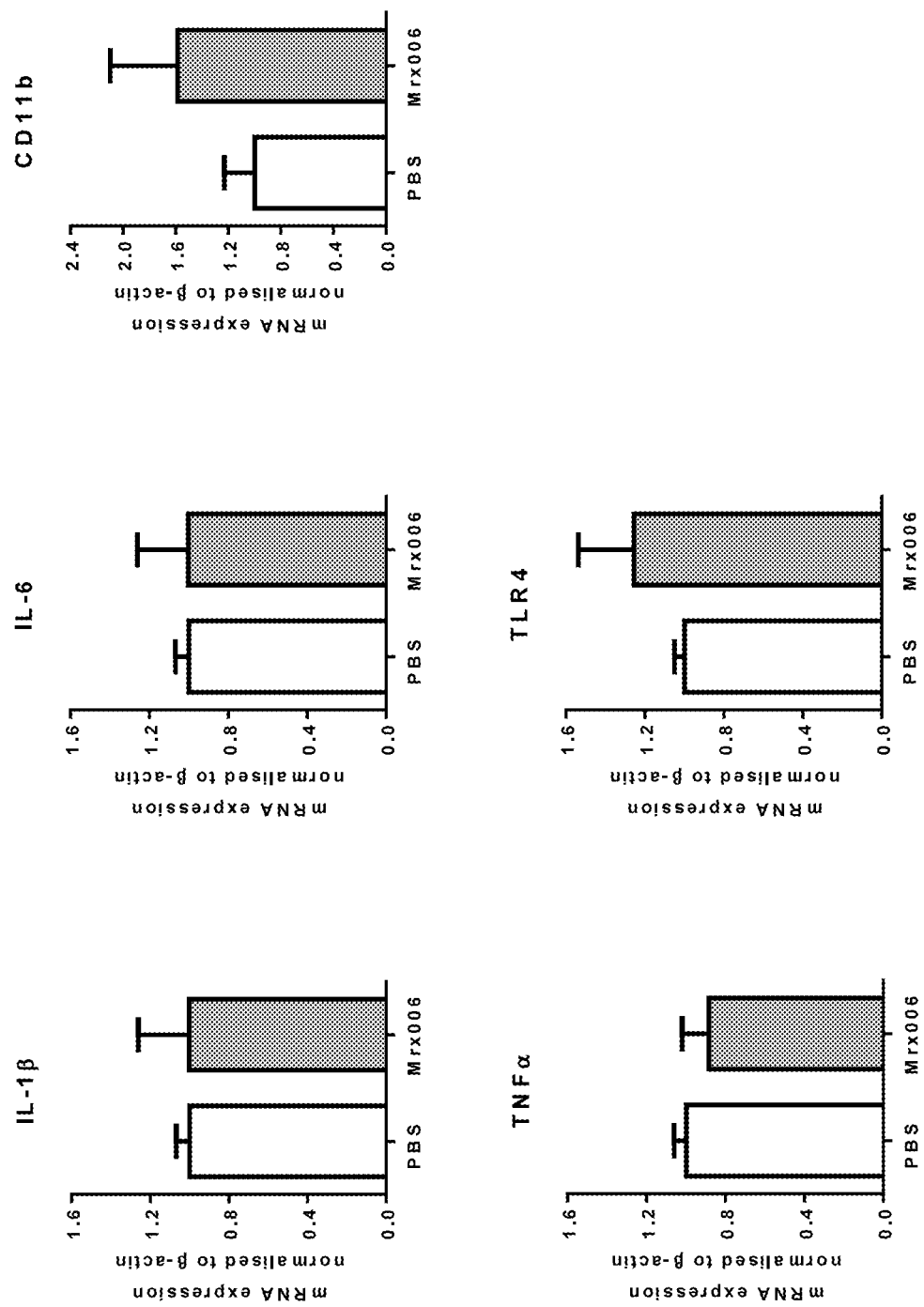
FIG. 70: Effect of chronic treatment with MRX006 on gene expression of inflammatory markers in the amygdalar in BALBc mouse model.

In the hippocampus and amygdala (FIGS. 69 and 70) there was no effect on mRNA expression of the various inflammatory markers. MRX006 had no effect on Hippocampal gene expression of the inflammatory markers IL-1β ($t_{10}$=1.346, p=0.208), IL-6 ($t_{12}$=1.041, p=0.308), CD11b ($t_{12}$=1.195, p=0.255), TNFα ($t_{11}$=0.816, p=0.342), TLR4 ($t_{12}$=0.521, p=0.612). MRX006 had no effect on amygdalar gene expression of the inflammatory markers IL-1β ($t_{11}$=1.53, p=0.988), IL-6 ($t_{11}$=1.145, p=0.217), CD11b ($t_{11}$=1.143, p=0.275), TLR4 ($t_{11}$=0.971, p=0.532).

Figure 71:
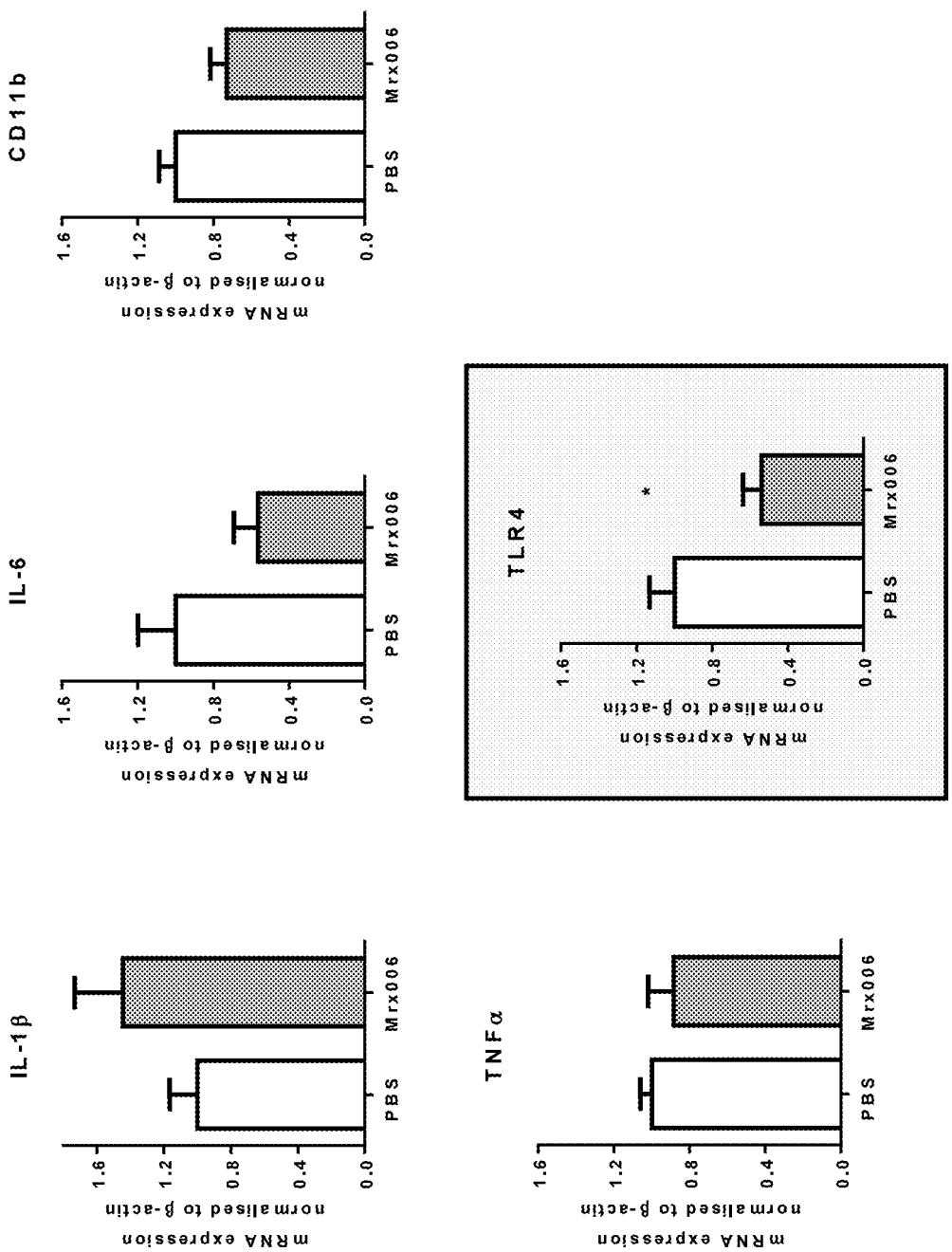
FIG. 71: Effect of chronic treatment with MRX006 on gene expression of inflammatory markers in the prefrontal cortex in BALBc mouse model.

In the prefrontal cortex, MRX006 decreased mRNA expression for TLR4 without any changes in other inflammatory markers (FIG. 71). MRX006 significantly decreased mRNA expression of TLR4 ($t_{12}$=2.639, p=0.0216) in the prefrontal cortex, but had no further effect on the prefrontal cortex gene expression for IL-6 ($t_{11}$=1.145, p=0.217) or CD11b ($t_{11}$=2.175, p=0.523).

Figure 72:
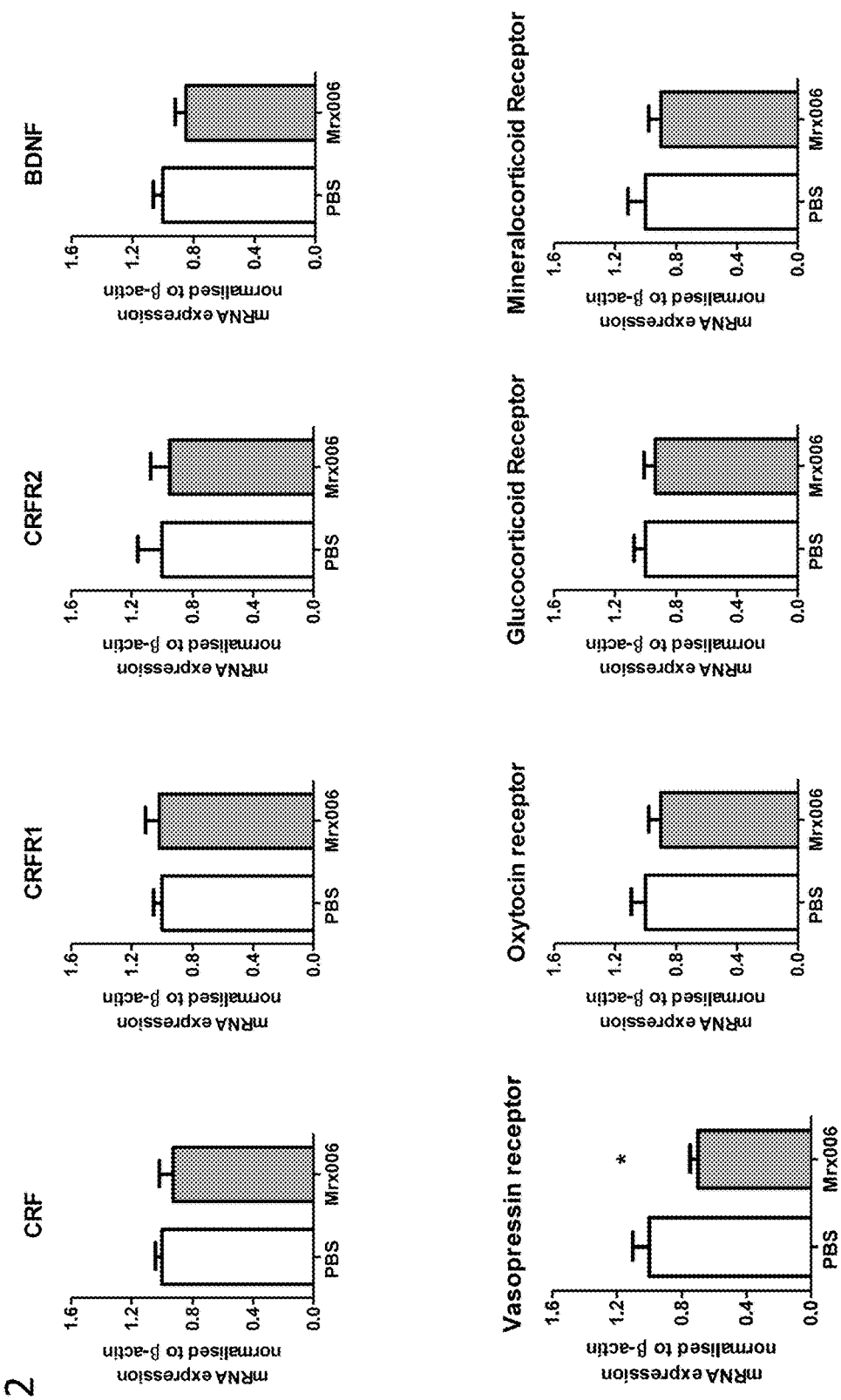
FIG. 72: Effect of chronic treatment with MRX006 on gene expression of hippocampal endocrine markers in BALBc mouse model.

MRX006 significantly decreased vasopressin receptor mRNA expression in hippocampus ($t_{12}$=2.389, p=0.0342), but had no further effect on mRNA expression for endocrine markers CRF ($t_{12}$=0.767, p=0.458), CRFR1 ($t_{12}$=0.174, p=0.865), CRFR2 ($t_{11}$=0.238, p=0.816), BDNF ($t_{12}$=1.548, p=0.148), oxytocin receptor ($t_{12}$=0.762, p=0.461), glucocorticoid receptor ($t_{12}$=0.607, p=0.556), mineralocorticoid receptor ($t_{12}$=0.67, p=0.516) (FIG. 72).

Figure 73:
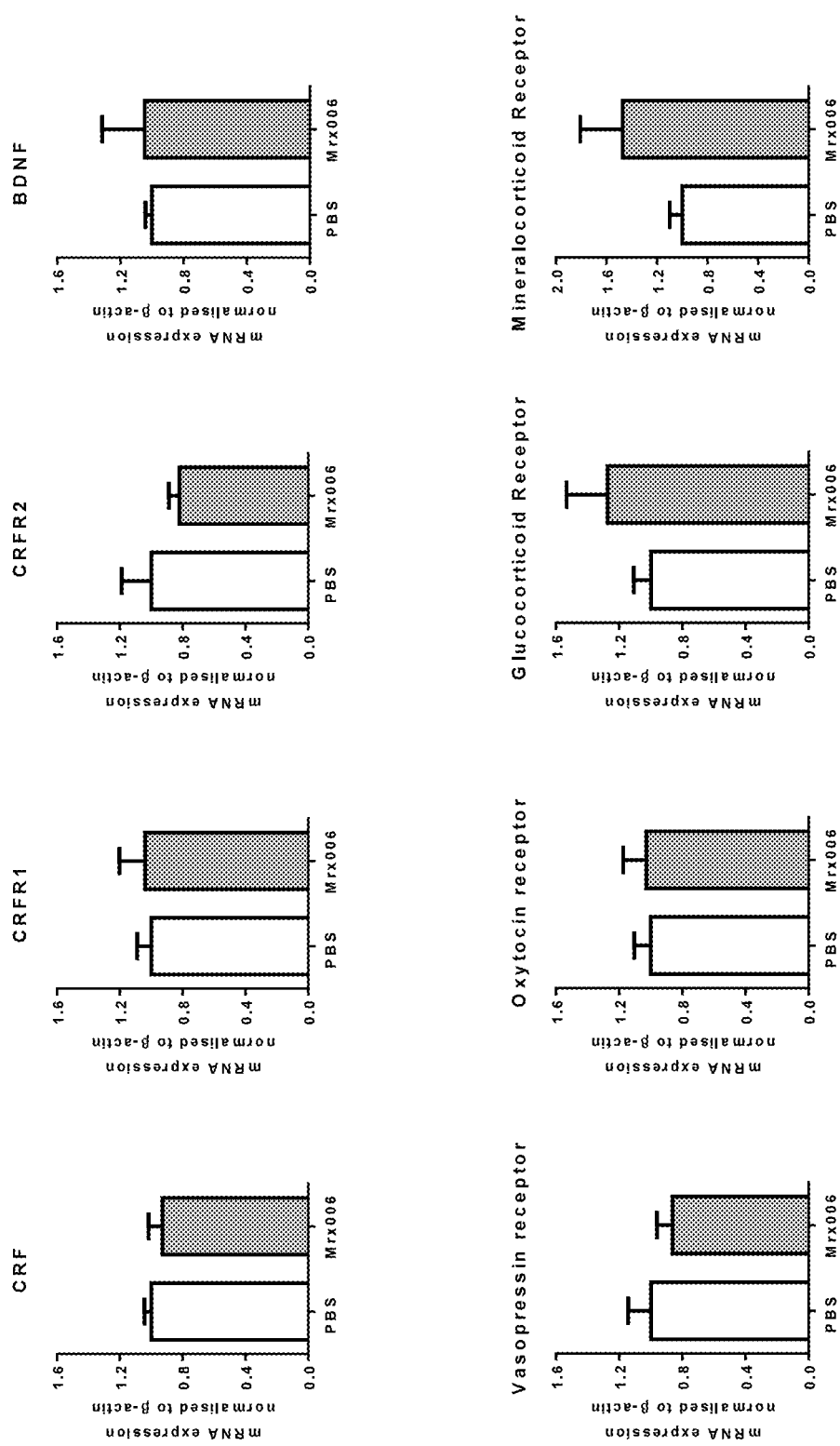
FIG. 73: Effect of chronic treatment with MRX006 on gene expression of amygdalar endocrine markers in BALBc mouse model.

MRX006 had no effect on mRNA expression of amygdalar endocrine markers CRFR1 ($t_{12}$=0.226, p=0.825), CRFR2 ($t_{11}$=0.78, p=0.451), BDNF ($t_{12}$=0.201, p=0.844), vasopressin receptor ($t_{12}$=0.756, p=0.465), oxytocin receptor ($t_{11}$=0.167, p=0.87), glucocorticoid receptor ($t_{11}$=1.027, p=0.327), mineralocorticoid receptor ($t_{11}$=1.448, p=0.175) (FIG. 73).

Figure 74:
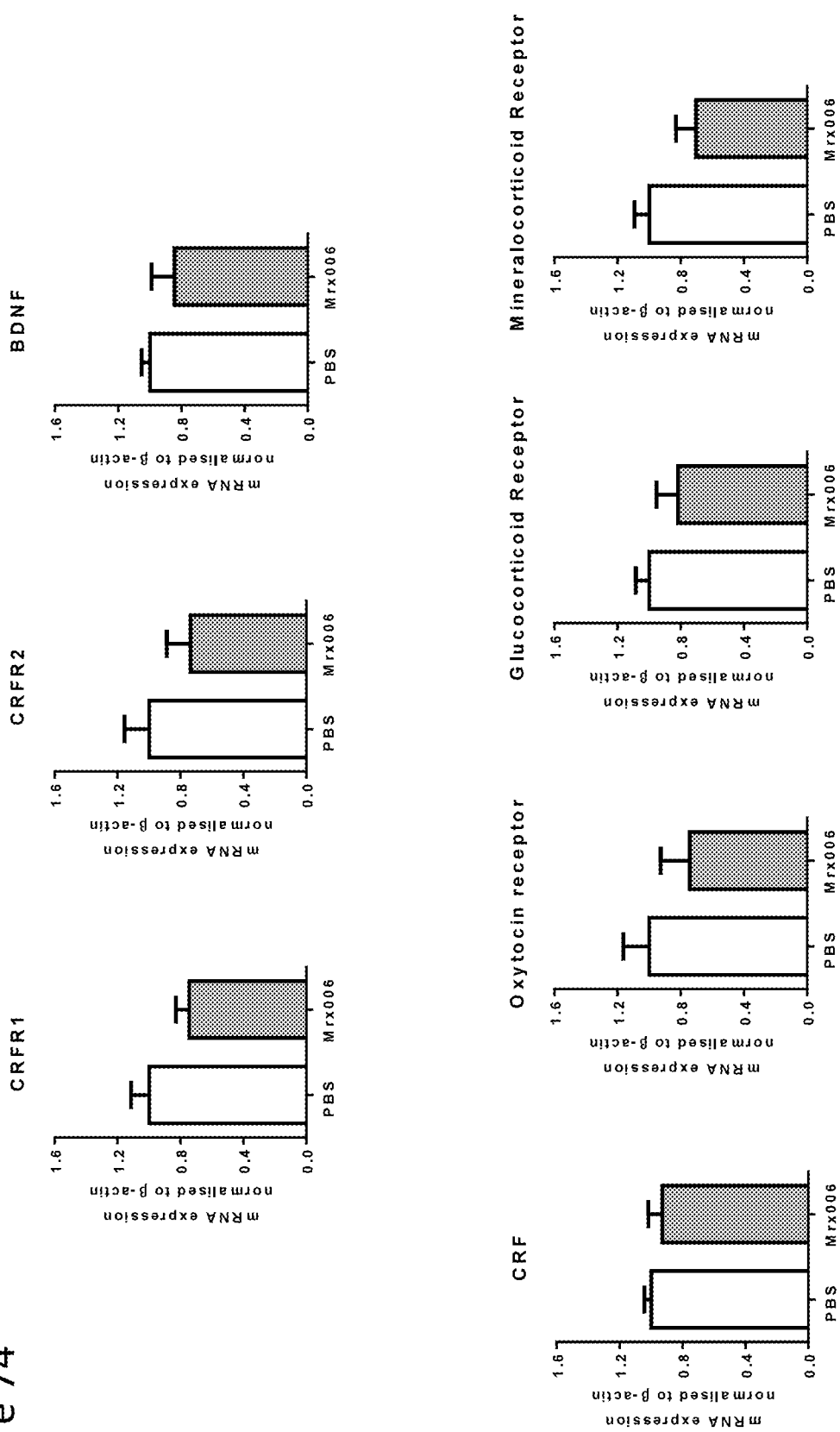
FIG. 74: Effect of chronic treatment with MRX006 on gene expression of prefrontal cortex endocrine markers in BALBc mouse model.

MRX006 had no effect on mRNA expression of the prefrontal cortex endocrine markers CRFR1 ($t_{12}$=1.666, p=0.122), CRFR2 ($t_{11}$=1.179, p=0.261), BDNF ($t_{11}$=1.065, p=0.310), oxytocin receptor ($t_{11}$=1.037, p=0.322), glucocorticoid receptor ($t_{12}$=1.185, p=0.259), mineralocorticoid receptor ($t_{11}$=1.910, p=0.083) (FIG. 74).

In the amygdala and the prefrontal cortex (FIGS. 73 and 74), there were no changes in mRNA expression of any endocrine markers, while in the hippocampus (FIG. 72) there was a decrease in mRNA expression of vasopressin receptor without any effect on the other endocrine markers analysed.

Discussion

The central gene expression for inflammatory, endocrine and neurotransmitter receptors were mostly unaltered following 6-day MRX006 administration.

Overall Conclusions Regarding MRX006 Administration on Physiological Parameters

Overall these data confirm that MRX006 administration does not negatively impact on systemic and central physiological events. These data suggest that MRX006 may have a high tolerability profile with minimal non-desirable side-effects.

Example 17—The Maternal Immune Activation (MIA) Mouse Model

The MIA mice used are the same as described in Example 3a.

Figure 75:
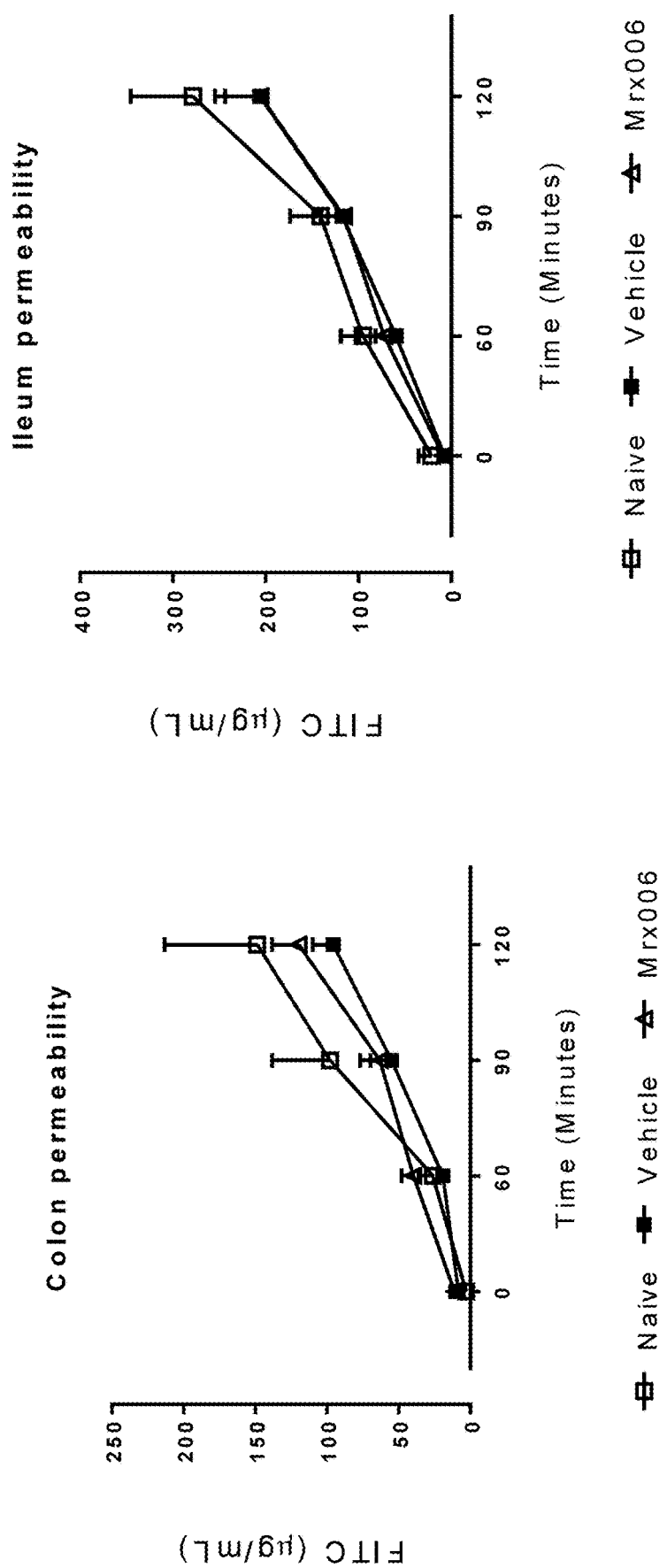
FIG. 75: Effect of chronic treatment with MRX006 on in vivo gastrointestinal permeability in the colon and ileum in MIA mouse model.

Example 17a—Assessing the Effects of Chronic Treatment with MRX006 on In Vivo Gastrointestinal Permeability in MIA Model The permeability of the ileum and colon was assessed in vivo using Ussing chambers as described in Example 2k. FIG. 75 demonstrates that chronic treatment with MRX006 does not influence the permeability of the colon or ileum in MIA model.

This confirms that chronic treatment with MRX006 does not alter the gut permeability, which shows that the beneficial social behaviour, reduce anxiety-like behaviour and stereotype behaviour effects of MRX006 do not lead to a deficit in the integrity of the gut.

Example 17b—Assessment of Social Behaviours—the Three Chamber Social Interaction Test The 3-Chamber Social Interaction Test (3-CSIT) was conducted as described on example 1a, however this data was manually scored by a researcher that was blinded to treatment. The data in example 1a was automatically generated by computer tracking software which cannot distinguish between interaction with the mouse and just being in the same chamber as the mouse.

Figure 76:
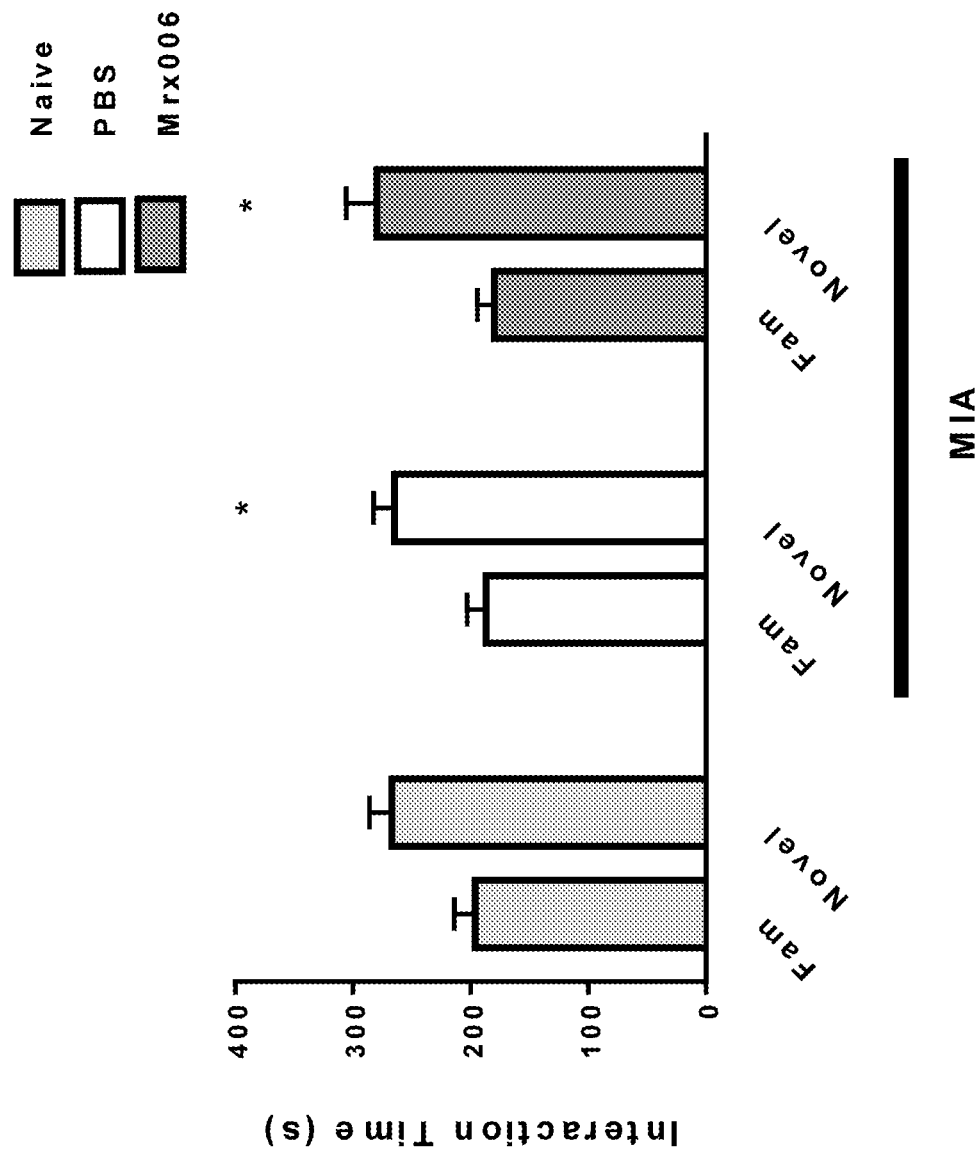
FIG. 76: Effect of treatment with MRX006 on social novelty in the three chamber social interaction test in MIA mice.

In the social novelty test (FIG. 76), there was no MIA-induced deficit in social discrimination and MRX006 had no further effect on social novelty.

Figure 77:
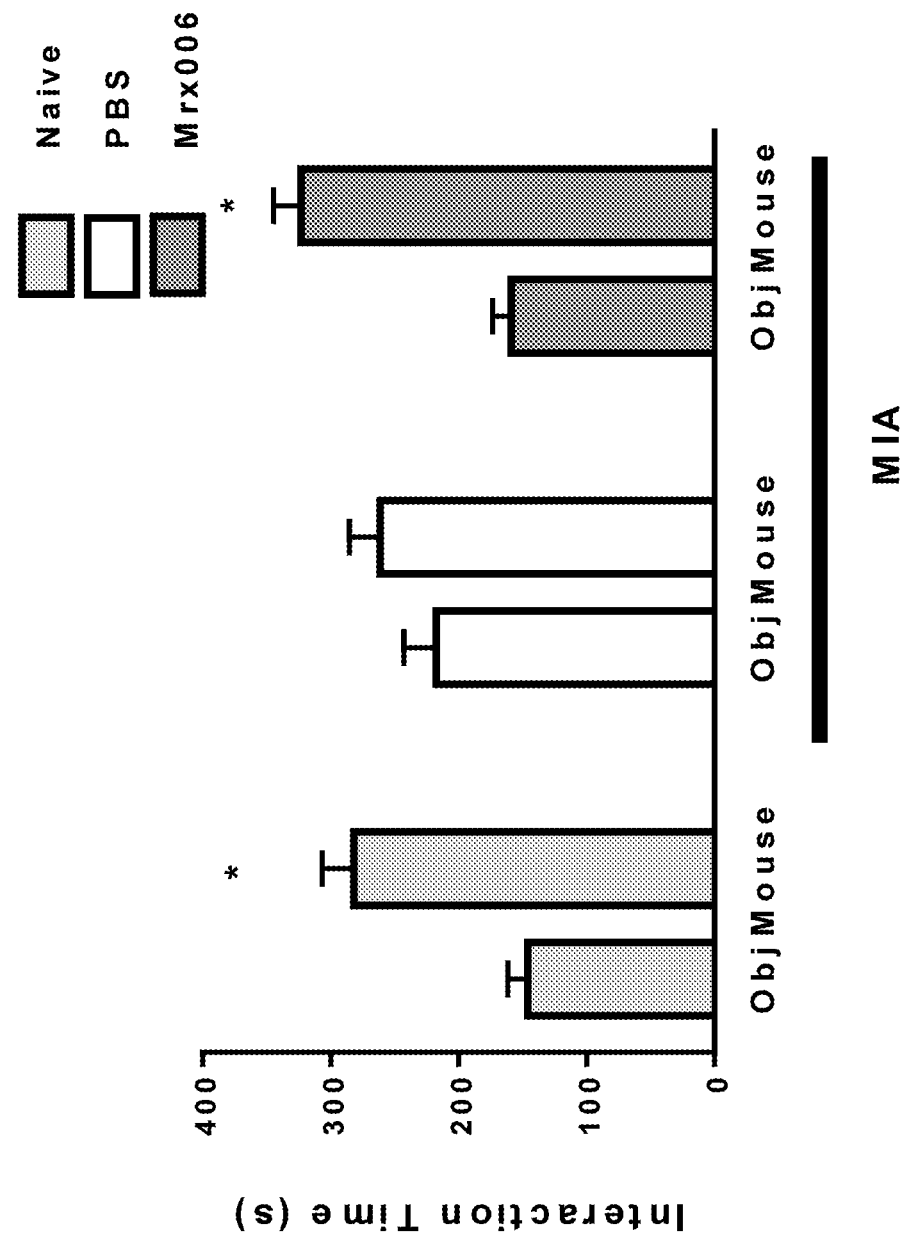
FIG. 77: Effect of treatment with MRX006 on social preference in the three chamber social interaction test in MIA mice.

FIG. 77 shows that in the sociability test, MRX006 was able to reverse MIA-induced deficits in social behaviour. This is similar to data seen in the BTBR model where MRX006 could reverse deficits in sociability.

Example 17c—Assessment of Social Behaviours—the Grooming Test

Figure 78:
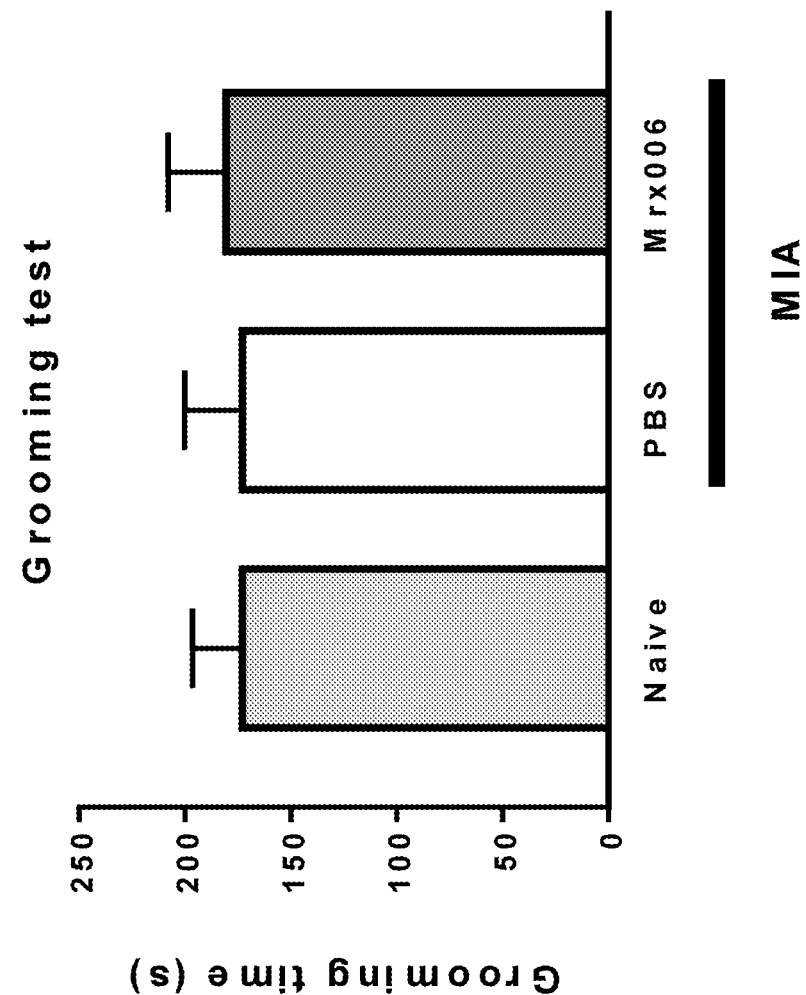
FIG. 78: Effect of treatment with MRX006 on MIA mice in the grooming test.

The grooming test was conducted as described in example 2e. Chronic treatment with MRX006 did not lead to a change in repetitive behaviours in MIA mice in the grooming test (FIG. 78).

Example 17d—Assessment of Social Behaviours—the Elevated Plus Maze

Figure 79:
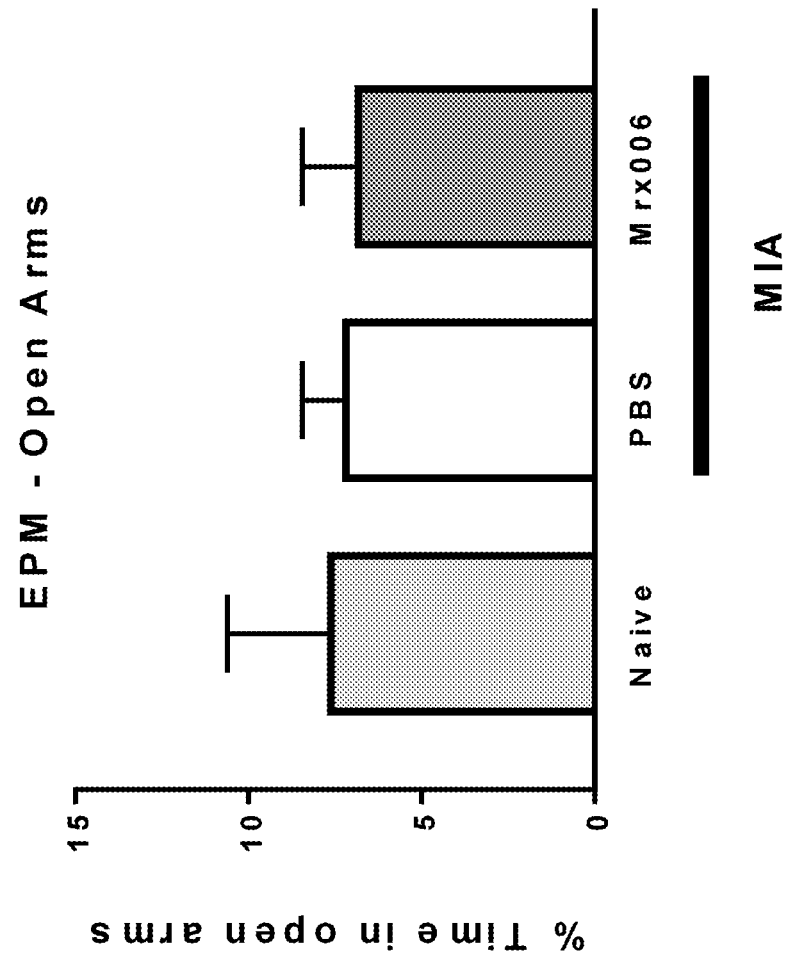
FIG. 79: Effect of treatment with MRX006 on MIA mice in the elevated plus maze test.

The elevated plus maze test was conducted as described in example 2f. Treatment with MRX006 has no effect on anxiety-like behaviour in MIA mice in the elevated plus maze (FIG. 79).

Example 17e—Assessment of Social Behaviours—the Forced Swim Test

Figure 80:
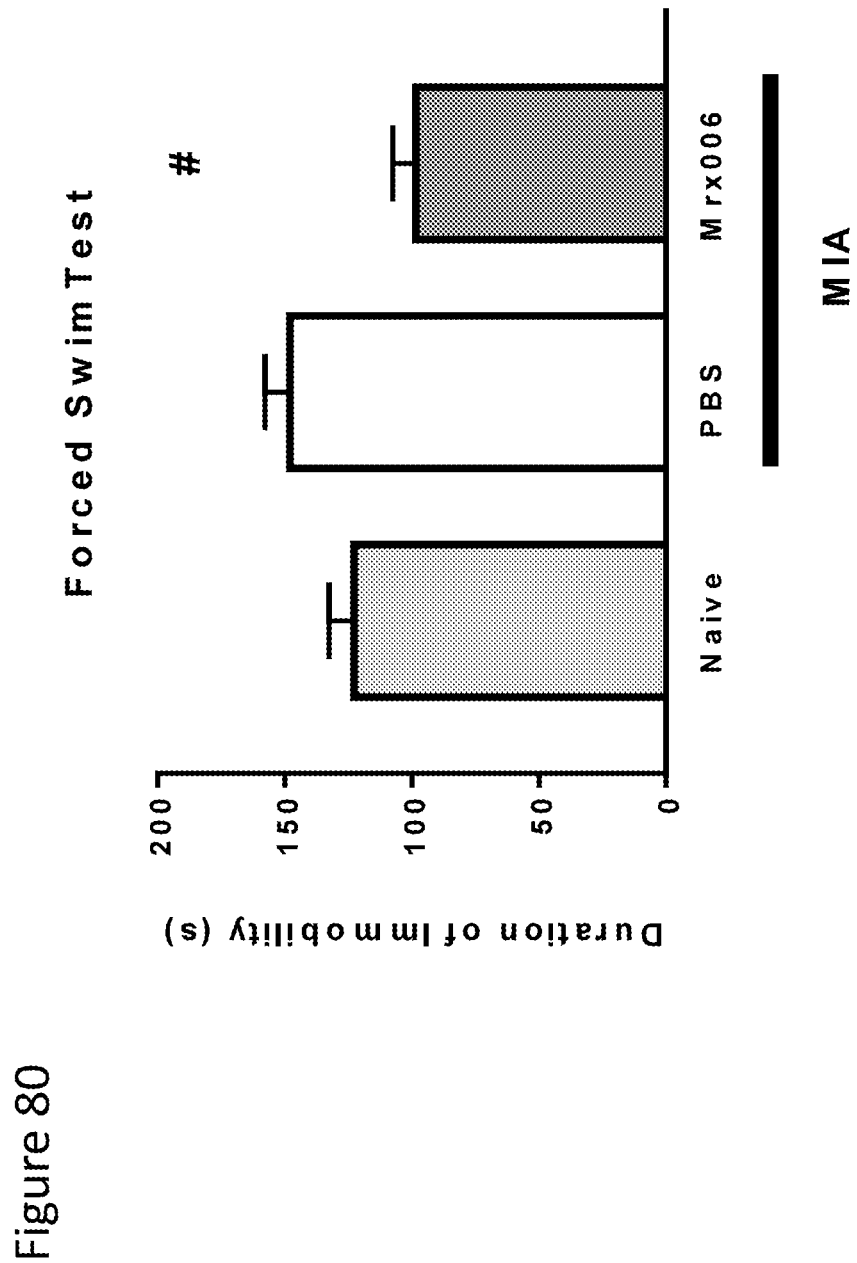
FIG. 80: Effect of treatment with MRX006 on MIA mice in the forced swim test.

The forced swim test was conducted as described in example 2h. Chronic treatment with MRX006 did reduce the immobility time of MIA mice in the forced swimming test (FIG. 80).

Example 17f—Stress-Induced Circulating Corticosterone Determination

Figure 81:
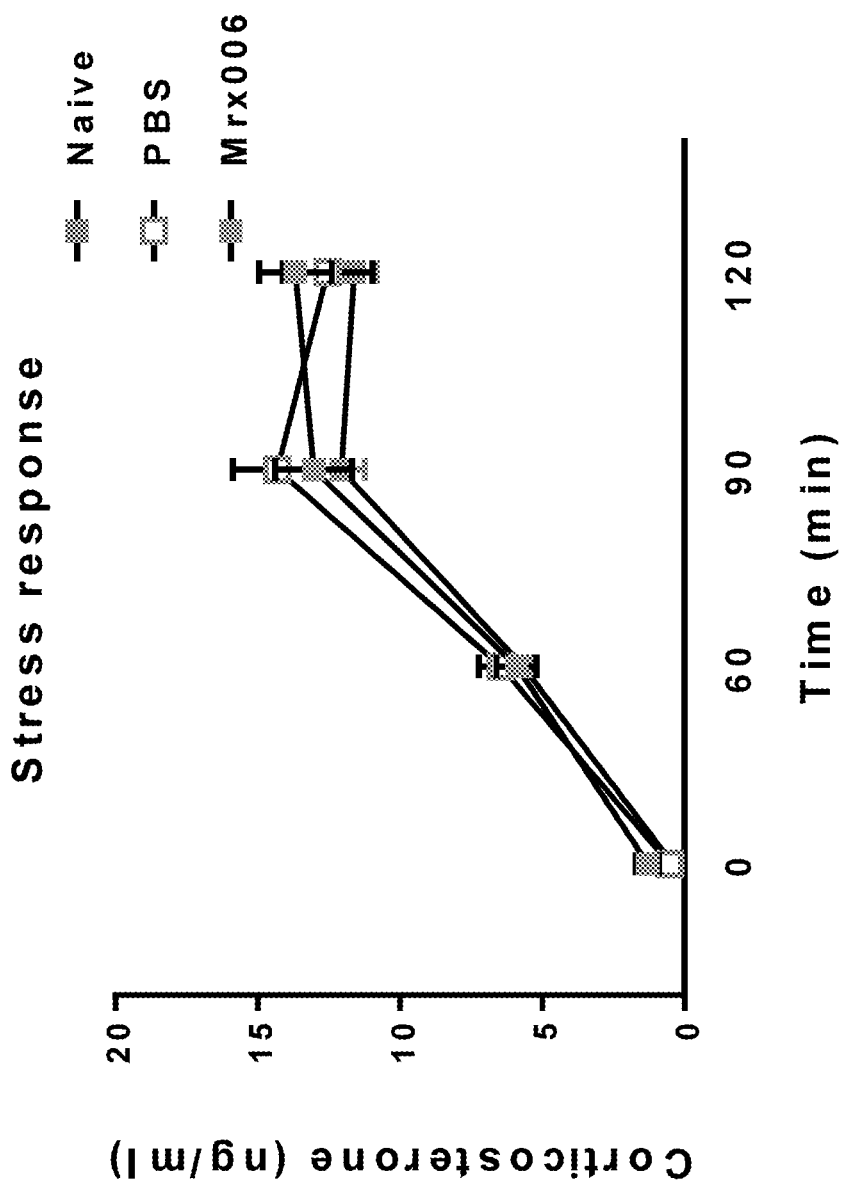
FIG. 81: Effect of treatment with MRX006 on stress-induced corticosterone plasma levels in MIA mice.

The levels of corticosterone were measured as described in example 2n. Chronic treatment with MRX006 does not influence stress-induced corticosterone levels in MIA mice exposed to the forced swimming test (FIG. 81).

Conclusions

Treatment with MRX006 reversed MIA-induced deficits in social behaviour and reduced the immobility time in the forced swimming test. This demonstrates the ability of MRX006 to improve the sociability and antidepressant activity.

In addition to the results described above in example 3, MRX006 has been demonstrated to have a positive impact on the symptoms of autistic spectrum disorders.

```
Sequences
(Blautia stercoris strain GAM6-1 16S ribosomal RNA gene, partial sequence -
HM626177)
                                                                SEQ ID NO: 1
     1 tgcaagtcga gcgaagcgct tacgacagaa ccttcggggg aagatgtaag ggactgagcg 61 gcggacgggt gagtaacgcg tgggtaacct gcctcataca gggggataac agttggaaac 121 ggctgctaat accgcataag cgcacggtat cgcatgatac agtgtgaaaa actccggtgg 181 tatgagatgg acccgcgtct gattagctag ttggaggggt aacggcccac caaggcgacg 241 atcagtagcc ggcctgagag ggtgaacggc cacattggga ctgagacacg gcccagactc 301 ctacgggagg cagcagtggg gaatattgca caatggggga aaccctgatg cagcgacgcc 361 gcgtgaagga agaagtatct cggtatgtaa acttctatca gcagggaaga aaatgacggt 421 acctgactaa gaagccccgg ctaactacgt gccagcagcc gcggtaatac gtaggggggca 481 agcgttatcc ggatttactg ggtgtaaagg gagcgtagac ggaagagcaa gtctgatgtg 541 aaaggctggg gcttaacccc aggactgcat tggaaactgt ttttcttgag tgccggagag 601 gtaagcggaa ttcctagtgt agcggtgaaa tgcgtagata ttaggaggaa caccagtggc 661 gaaggcggct tactggacgg taactgacgt tgaggctcga aagcgtgggg agcaaacagg 721 attagatacc ctggtagtcc acgccgtaaa cgatgaatac taggtgttgg ggagcaaagc 781 tcttcggtgc cgcagcaaac gcaataagta ttccacctgg ggagtacgtt cgcaagaatg
```

```
 841 aaactcaaag gaattgacgg ggacccgcac aagcggtgga gcatgtggtt taattcgaag 901 caacgcgaag aaccttacca agtcttgaca tcgatctgac cggttcgtaa tggaacettt 961 ccttcgggac agagaagaca ggtggtgcat ggttgtcgtc agctcgtgtc gtgagatgtt 1021 gggttaagtc ccgcaacgag cgcaacccct atcctcagta gccagcaggt gaagctgggc 1081 actctgtgga gactgccagg gataacctgg aggaaggcgg ggacgacgtc aaatcatcat 1141 gccccttatg atttgggcta cacacgtgct acaatggcgt aaacaaaggg aagcgagccc 1201 gcgaggggga gcaaatccca aaaataacgt cccagttcgg actgcagtct gcaactcgac 1261 tgcacgaagc tggaatcgct agtaatcgcg aatcagaatg tcgcggtgaa tacgttcccg 1321 ggtcttgtac acaccgcccg tcacaccatg ggagtcagta acgcccgaag tc
```

(consensus 16S rRNA sequence for *Blautia stercoris* MRX006 (strain 830))

SEQ ID NO: 2

```
TTTKGTCTGGCTCAGGATGAACGCTGGCGGCGTGCTTAACACATGCAAGTCGAGCGAAGCGCTTACGACAGAACCTT
CGGGGGAAGATGTAAGGGACTGAGCGGCGGACGGGTGAGTAACGCGTGGGTAACCTGCCTCATACAGGGGGATAACA
GTTGGAAACGGCTGCTAATACCGCATAAGCGCACAGTATCGCATGATACAGTGTGAAAAACTCCGGTGGTATGAGAT
GGACCCGCGTCTGATTAGCTAGTTGGAGGGGTAACGGCCCACCAAGGCGACGATCAGTAGCCGGCCTGAGAGGGTGA
ACGGCCACATTGGGACTGAGACACGGCCCAGACTCCTACGGGAGGCAGCAGTGGGGAATATTGCACAATGGGGGAAA
CCCTGATGCAGCGACGCCGCGTGAAGGAAGAAGTATCTCGGTATGTAAACTTCTATCAGCAGGGAAGAAAATGACGG
TACCTGACTAAGAAGCCCCGGCTAACTACGTGCCAGCAGCCGCGGTAATACGTAGGGGGCAAGCGTTATCCGGATTT
ACTGGGTGTAAAGGGAGCGTAGACGGAAGAGCAAGTCTGATGTGAAAGGCTGGGGCTTAACCCCAGGACTGCATTGG
AAACTGTTTTTCTTGAGTGCCGGAGAGGTAAGCGGAATTCCTAGTGTAGCGGTGAAATGCGTAGATATTAGGAGGAA
CACCAGTGGCGAAGGCGGCTTACTGGACGGTAACTGACGTTGAGGCTCGAAAGCGTGGGGAGCAAACAGGATTAGAT
ACCCTGGTAGTCCACGCCGTAAACGATGAATACTAGGTGTTGGGGAGCAAAGCTCTTCGGTGCCGCAGCAAACGCAA
TAAGTATTCCACCTGGGGAGTACGTTCGCAAGAATGAAACTCAAAGGAATTGACGGGGACCCGCACAAGCGGTGGAG
CATGTGGTTTATTCGAAGCAACGCGAAGAACCTTACCAAGTCTTGACATCGATCTGACCGGTTCGTAATGGAACCTT
TCCTTCGGGACAGAGAAGACAGGTGGTGCATGGTTGTCGTCAGCTCGTGTCGTGAGATGTTGGGTTAAGTCCCGCAA
CGAGCGCAACCCCTATCGTCAGTAGCCAGCAGGTAAAGCTGGGCACTCTGAGGAGACTGCCAGGGATAACCTGGAGG
AAGGCGGGGACGACGTCAAATCATCATGCCCCTTATGATTTGGGCTACACACGTGCTACAATGGCGTAAACAAAGGG
AAGCGAGCCCGCGAGGGGAGCAAATCCCAAAAATAACGTCCCAGTTCGGACTGCAGTCTGCAACTCGACTGCACGA
AGCTGGAATCGCTAGTAATCGCGAATCAGAATGTCGCGGTGAATACGTTCCCGGGTCTTGTACACACCGCCCGTCAC
ACCATGGGAGTCAGTAACGCCCGAAGTCAGTGACCCAACCTTAGGGAGGGAGCTGCCGAAGGCGGGATTGATAACTG
GGGTGAAGTCTAGGGGGT
```

(*Blautia wexlerae* strain WAL 14507 16S ribosomal RNA gene, partial sequence - EF036467)

SEQ ID NO: 3

```
  1 caagtcgaac gggaattant ttattgaaac ttcggtcgat ttaatttaat tctagtggcg 61 gacgggtgag taacgcgtgg gtaacctgcc ttatacaggg ggataacagt cagaaatggc 121 tgctaatacc gcataagcgc acagagctgc atggctcagt gtgaaaaact ccggtggtat 181 aagatggacc cgcgttggat tagcttgttg gtggggtaac ggcccaccaa ggcgacgatc 241 catagccggc ctgagagggt gaacggccac attgggactg agacacggcc cagactccta 301 cgggaggcag cagtggggaa tattgcacaa tgggggaaac cctgatgcag cgacgccgcg 361 tgaaggaaga agtatctcgg tatgtaaact tctatcagca gggaagatag tgacggtacc 421 tgactaagaa gccccggcta actacgtgcc agcagccgcg gtaatacgta gggggcaagc 481 gttatccgga tttactgggt gtaaagggag cgtagacggt gtggcaagtc tgatgtgaaa
```

```
541 ggcatgggct caacctgtgg actgcattgg aaactgtcat acttgagtgc cggaggggta 601 agcggaattc ctagtgtagc ggtgaaatgc gtagatatta ggaggaacac cagtggcgaa 661 ggcggcttac tggacggtaa ctgacgttga ggctcgaaag cgtggggagc aaacaggatt 721 agataccctg gtagtccacg ccgtaaacga tgaataacta ggtgtcgggt ggcaaagcca 781 ttcggtgccg tcgcaaacgc agtaagtatt ccacctgggg agtacgttcg caagaatgaa 841 actcaaagga attgacgggg acccgcacaa gcggtggagc atgtggttta attcgaagca 901 acgcgaagaa ccttaccaag tcttgacatc cgcctgaccg atccttaacc ggatctttcc 961 ttcgggacag gcgagacagg tggtgcatgg ttgtcgtcag ctcgtgtcgt gagatgttgg 1021 gttaagtccc gcaacgagcg caaccccctat cctcagtagc cagcatttaa ggtgggcact 1081 ctggggagac tgccagggat aacctggagg aaggcgggga tgacgtcaaa tcatcatgcc 1141 ccttatgatt tgggctacac acgtgctaca atggcgtaaa caagggaag cgagattgtg 1201 agatggagca atcccaaaaa ataacgtccc agttcggact gtagtctgca acccgactac 1261 acgaagctgg aatcgctagt aatcgcggat cagaatgccg cggtgaatac gttcccgggt 1321 cttgtacaca ccgcccgtca caccatggga gtcagtaacg cccgaagtca gtgacctaac 1381 tgcaaagaag gagctgccga aggcgggacc gatgactggg gtgaagtcgt aacaaggt
```

(consensus 16S rRNA sequence for *Blautia wexlerae* strain MRX008)
SEQ ID NO: 4

```
TTCATTGAGACTTCGGTGGATTTAGATTCTATTTCTAGTGGCGGACGGGTGAGTAACGCGTGGGTAACCTGCCTTAT
ACAGGGGGATAACAGTCAGAAATGGCTGCTAATACCGCATAAGCGCACAGAGCTGCATGGCTCAGTGTGAAAAACTC
CGGTGGTATAAGATGGACCCGCGTTGGATTAGCTTGTTGGTGGGGTAACGGCCCACCAAGGCGACGATCCATAGCCG
GCCTGAGAGGGTGAACGGCCACATTGGGACTGAGACACGGCCCAGACTCCTACGGGAGGCAGCAGTGGGGAATATTG
CACAATGGGGGAAACCCTGATGCAGCGACGCCGCGTGAAGGAAGAAGTATCTCGGTATGTAAACTTCTATCAGCAGG
GAAGATAGTGACGGTACCTGACTAAGAAGCCCCGGCTAACTACGTGCCAGCAGCCGCGGTAATACGTAGGGGGCAAG
CGTTATCCGGATTTACTGGGTGTAAAGGGAGCGTAGACGGTGTGGCAAGTCTGATGTGAAAGGCATGGGCTCAACCT
GTGGACTGCATTGGAAACTGTCATACTTGAGTGCCGGAGGGGTAAGCGGAATTCCTAGTGTAGCGGTGAAATGCGTA
GATATTAGGAGGAACACCAGTGGCGAAGGCGGCTTACTGGACGGTAACTGACGTTGAGGCTCGAAAGCGTGGGGAGC
AAACAGGATTAGATACCCTGGTAGTCCACGCCGTAAACGATGAATACTAGGTGTCNGGGGAGCATGGCTCTTCGGTG
CCGTCGCAAACGCAGTAAGTATTCCACCTGGGGAGTACGTTCGCAAGAATGAAACTCAAAGGAATTGACGGGGACCC
GCACAAGCGGTGGAGCATGTGGTTTAATTCGAAGCAACGCGAAGAACCTTACCAAGTCTTGACATCCGCCTGACCGA
TCCTTAACCGGATCTTTCCTTCGGGACAGGCGAGACAGGTGGTGCATGGTTGTCGTCAGCTCGTGTCGTGAGATGTT
GGGTTAAGTCCCGCAACGAGCGCAACCCCTATCCTCAGTAGCCAGCATTTAAGGTGGGCACTCTGGGGAGACTGCCA
GGGATAACCTGGAGGAAGGCGGGGATGACGTCAAATCATCATGCCCCTTATGATTTGGGCTACACACGTGCTACAAT
GGCGTAAACAAAGGGAAGCGAGATCGTGAGATGGAGCAAATCCCAAAAATAACGTCCCAGTTCGGACTGTAGTCTGC
AACCCGACTACACGAAGCTGGAATCGCTAGTAATCGCGGATCAGAATGCCGCGGTGAATACGTTCCCGGGTCTTGTA
CACACCGCCCGTCACACCATGGGAGTCAGTAACGCCCGAAGTCAGTGACCTAACTGCAAAGAAGGAGCTGCCGAA
```

(MRX006 (strain 830) chromosome sequence) - see electronic sequence listing.
SEQ ID NO: 5

(MRX006 (strain 830) plasmid sequence) - see electronic sequence listing.
SEQ ID NO: 6

(*Blautia hydrogenotrophica* strain S5a36 16S ribosomal RNA gene, partial sequence - X95624.1)
SEQ ID NO: 7

```
  1 gatgaacgct ggcggcgtgc ttaacacatg caagtcgaac gaagcgatag agaacggaga 61 tttcggttga agttttctat tgactgagtg gcggacgggt gagtaacgcg tgggtaacct
```

```
121 gccctataca gggggataac agttagaaat gactgctaat accgcataag cgcacagctt 181 cgcatgaagc ggtgtgaaaa actgaggtgg tataggatgg acccgcgttg gattagctag 241 ttggtgaggt aacggcccac caaggcgacg atccatagcc ggcctgagag ggtgaacggc 301 cacattggga ctgagacacg gcccaaactc ctacggagg cagcagtggg gaatattgca 361 caatggggga aaccctgatg cagcgacgcc gcgtgaagga agaagtatct cggtatgtaa 421 acttctatca gcagggaaga aagtgacggt acctgactaa gaagcccgg ctaattacgt 481 gccagcagcc gcggtaatac gtaaggggca agcgttatcc ggatttactg ggtgtaaagg 541 gagcgtagac ggtttggcaa gtctgatgtg aaaggcatgg gctcaacctg tggactgcat 601 tggaaactgt cagacttgag tgccggagag gcaagcggaa ttcctagtgt agcggtgaaa 661 tgcgtagata ttaggaggaa caccagtggc gaaggcggcc tgctggacgg taactgacgt 721 tgaggctcga aagcgtgggg agcaaacagg attagatacc ctggtagtcc acgctgtaaa 781 cgatgaatac taggtgtcgg gtggcaaagc cattcggtgc cgcagcaaac gcaataagta 841 ttcccacctg gggagtacgt tcgcaagaat gaaactcaaa ggaattgacg gggacccgca 901 caagcggtgg agcatgtggt ttaattcgaa gcaacgcgaa gaaccttacc aaatcttgac 961 atccctctga ccgggaagta atgttccctt ttcttcggaa cagaggagac aggtggtgca 1021 tggttgtcgt cagctcgtgt cgtgagatgt tgggttaagt cccgcaacga gcgcaaccct 1081 tattcttagt agccagcagg tagagctggg cactctaggg agactgccag ggataacctg 1141 gaggaaggtg gggatgacgt caaatcatca tgccccttat gatttgggct acacacgtgc 1201 tacaatggcg taaacaaagg gaagcgaagg ggtgacctgg agcaaatctc aaaaataacg 1261 tctcagttcg gattgtagtc tgcaactcga ctacatgaag ctggaatcgc tagtaatcgc 1321 gaatcagaat gtcgcggtga atacgttccc gggtcttgta cacaccgccc gtcacaccat 1381 gggagtcagt aacgcccgaa gtcagtgacc caaccnaaag gagggagctg ccgaaggtgg 1441 gactgataac tggggtga
```

REFERENCES

[1] Spor et al. (2011) Nat Rev Microbiol. 9(4):279-90.
[2] Eckburg et al. (2005) Science. 10; 308(5728):1635-8.
[3] Macpherson et al. (2001) Microbes Infect. 3(12):1021-35
[4] Macpherson et al. (2002) Cell Mol Life Sci. 59(12):2088-96.
[5] Mazmanian et al. (2005) Cell 15; 122(1):107-18.
[6] Frank et al. (2007) PNAS 104(34):13780-5.
[7] Scanlan et al. (2006) J Clin Microbiol. 44(11):3980-8.
[8] Kang et al. (2010) Inflamm Bowel Dis. 16(12):2034-42.
[9] Machiels et al. (2013) Gut. 63(8):1275-83. [10] Mayer et al (2014) The Journal of Neuroscience 34(46):15490-15496
[11] Cryan and Dinan (2015) Neuropsychopharmacology, 40: 241-2.
[12] Zhou and Foster (2015) Neuropsychiatric Disease and Treatment 11: 715-723.
[13] Wang and Kasper (2014) Brain Behav Immun. 38: 1-12.
[14] WO 2013/050792
[15] WO 03/046580
[16] WO 2013/008039
[17] WO 2014/167338
[18] Goldin and Gorbach (2008) Clin Infect Dis. 46 Suppl 2:S96-100.
[19] Azad et al. (2013) BMJ. 347:f6471.
[20] Bravo et al. (2011) Proc Natl Acad Sci USA, 108: 16050-5.
[21] Kantak et al. (2014) Behav Pharmacol. 25: 71-9.
[22] Savignac et al. (2014) Neurogastroenterol Motil. 26: 1615-27.
[23] de Theije et al. (2014) Brain Behav Immun. 37: 197-206.
[24] Hsiao et al. (2013) Cell, 155: 1451-63.
[25] Meyza and Blanchard (2017) Neurosci Biobehav Rev.
[26] Liu et al. (2008) Int J Syst Evol Microbiol 58, 1896-1902.
[27] Park et al. (2012) Int J Syst Evol Microbiol. 62(Pt 4):776-9.
[28] Liu et al. (2008) Int J Syst Evol Microbiol. 58(Pt 8):1896-902.
[29] Masco et al. (2003) Systematic and Applied Microbiology, 26:557-563.
[30] Srůtková et al. (2011) J Microbiol. Methods, 87(1):10-6.
[31] Bernalier et al. (1996) Arch. Microbiol. 166(3), 176-183.
[32] Wang et al. (2016) J Neurogastroenterol Motil 22:589-605.
[33] Li and Zhou (2016) Neuroscience 324:131-139.
[34] Hyland and Stanton (2016) The Gut-Brain Axis: Dietary, Probiotic and Prebiotic Interventions on the Microbiota (Academic Press).
[35] Bourassa et al. (2016) Neuroscience Letters 625, 56-63
[36] Miyamoto-Shinohara et al. (2008) J. Gen. Appl. Microbiol., 54, 9-24.

[37] Cryopreservation and Freeze-Drying Protocols, ed. by Day and McLellan, Humana Press.
[38] Leslie et al. (1995) *Appl. Environ. Microbiol.* 61, 3592-3597.
[39] Mitropoulou et al. (2013) *J Nutr Metab.* (2013) 716861.
[40] Kailasapathy et al. (2002) *Curr Issues Intest Microbiol.* 3(2):39-48.
[41] Handbook of Pharmaceutical Excipients, 2nd Edition, (1994), Edited by A Wade and P J Weller
[42] Remington's Pharmaceutical Sciences, Mack Publishing Co. (A. R. Gennaro edit. 1985)
[43] US 2016/0067188
[44] Handbook of Microbiological Media, Fourth Edition (2010) Ronald Atlas, CRC Press.
[45] Maintaining Cultures *for Biotechnology and Industry* (1996) Jennie C. Hunter-Cevera, Academic Press
[46] Strobel (2009) *Methods Mol Biol.* 581:247-61.
[47] Gennaro (2000) *Remington: The Science and Practice of Pharmacy.* 20th edition, ISBN: 0683306472.
[48] *Molecular Biology Techniques: An Intensive Laboratory Course*, (Ream et al., eds., 1998, Academic Press).
[49] *Methods In Enzymology* (S. Colowick and N. Kaplan, eds., Academic Press, Inc.)
[50] *Handbook of Experimental Immunology*, Vols. I-IV (D. M. Weir and C. C. Blackwell, eds, 1986, Blackwell Scientific Publications)
[51] Sambrook et al. (2001) *Molecular Cloning: A Laboratory Manual,* 3rd edition (Cold Spring Harbor Laboratory Press).
[52] *Handbook of Surface and Colloidal Chemistry* (Birdi, K. S. ed., CRC Press, 1997)
[53] Ausubel et al. (eds) (2002) *Short protocols in molecular biology,* 5th edition (Current Protocols).
[54] *PCR* (*Introduction to Biotechniques Series*), 2nd ed. (Newton & Graham eds., 1997, Springer Verlag)
[55] *Current Protocols in Molecular Biology* (F. M. Ausubel et al., eds., 1987) Supplement 30
[56] Smith & Waterman (1981) *Adv. Appl. Math.* 2: 482-489.
[57] Cryan and Mombereau (2004) *Mol Psychiatry* 9: 326-57.
[58] Hyland and Cox (2006) Br J Pharmacol. 146(5): 712-722

SEQUENCE LISTING (7 sequences)

SEQ ID NO: 1 - DNA, 1372 bp, Blautia stercoris
tgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacggtatcgcatgatacagtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctatcctcagtagccagcaggtgaagctgggcactctgtggagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtc

SEQ ID NO: 2 - DNA, 1481 bp, Blautia stercoris
tttkgtctggctcaggatgaacgctggcggcgtgcttaacacatgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacagtatcgcatgatacagtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctatcgtcagtagccagcaggtaaagctgggcactctgaggagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttagggagggagctgccgaaggcgggattgataactggggtgaagtctagggggt

SEQ ID NO: 3 - DNA, 1438 bp, Blautia wexlerae
  n 19: a, t, c or g
caagtcgaacgggaattantttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaataactaggtgtcgggtggcaaagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggt

SEQ ID NO: 4 - DNA, 1384 bp, Blautia wexlerae
  n 749: a, t, c or g
ttcattgagacttcggtggatttagattctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcnggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagatcgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaa

SEQ ID NO: 5 - DNA, 3415035 bp, Blautia stercoris strain 830 chromosome (residues 1-1,707,518 of 3,415,035)
aactgtggattttttacgagtccagtgtaattcatcttcaaaagttgatactgcactttctgttaatgcaatggaacttgtgattgccgcaaacaatactaacaggaaaaataaaattccaaccgcagttccgaatcccatatttgcaaatacttttggaatggtaataaacatcagtgccggaccagcatttaaggtatctgcatttccaccggagaaagcaaatactgccggaataatcataagacctgccatgattgcaattgcagtatcaaaaatttctacattttgggttgattcctcaattgaagtatctttcttcatataagaaccaaacgttactaaaatacccatcgcaattgacaaagaataaaacatctgtcccattgcagacactactgtcatccaggaaaagttcttaaaattcggtactaagaaatattttacaccttcaattgctcctggtcttgtcacagaataaactgcaataataactgataatacaaccagaatcggcatcataaatttagatacccgctcaattccgttacgcacacctgcataaataattccaagtgtggcaagggtaaagattaagaaacagatttctgttgataatccatttgaaataaagctggaaaaataatcatcggaagccagattcttggactgtcctcctatatatcccaccagatatttaataacccatcctccgataacggaataatacggtacaatcagaatcggaataattgcattaatccatcctccaactgcaaatccctttgactttccaaagtgctcaaatgcaccaacgggactctttctggtcatacgtcctaaagaactctctgccataatcatggtatagccaaatgtcagtgccagtatgatgtagaccagtaaaaagattcctccgccatatttcgctgccagatatggaaatcgccaaatatttccaaggcctacagaagcaccggctgctgacaatacaaaaccgagttttccagagaaggtacttcttttcttgtttttgtccataaaaatattctccttcttttttgaatatacctcttagtgtaacataggcatggcaaaaaagcaatcataaggactggaggttttttgtcaatcaagtggatattcgcaatccgctttgctacttgctcataaccaaatagctgctacgcagcttatcagaagggacttgccccctcctgatacaagcaagtccccacccctgcttattgcttttcgcaattgaagcaggggacttacttgatttggttaaattaaaaacagagagaacctttcaaccggaactctctgtttttggctctctcatcatttaataaataaattcaggaaaccggtagactgtaagaacaaaatggtcataatcaccggcatgatgtaacaaatcataatgttatataatttttttcggccaaatttgccaccatttaattccatctcttccgcaatccacttcggtttcataatccatccgattaaaatagaagaaagcaacgaaataaacggcatcaggaaactgttactgatatagtccataatatctaataactgtccgatacttccattcggaagtttgacttccacataaaagatactgtatcccagagcaatgactgctgttgcaattaagtaaataacagataacacttttgttgtaatttttctttttgcatgaaataattccatacagttcgcagtaatagattccaatacagaaatacaggaagttaatgctgcaaatccggcaagcacgaaaaatacaattccaattaacctgccggcaaatcccatactgaagaatacttttggcagagaaacaaacatcagcccaggaccggcggacattccgtctaatccagagaatacatagacagccgggataatcataacacctgctaaaaatgcaacaccggtatccataatttcaatctgggatacggccttatttaaatcaacgtctttttttacataagaaccataagtaatcatgatacccatagatacacttaaagaaaagaataactgactcatggcatccagtgtaatctgtaagaaacgactcactgtaagcccggagaaatcaggagtcaaataaacttttaaaccatcaataccggttcttactgttccatcatccagtgtattcttcagagttaatgaaaagatggcaattccaattaccatgactaaaagaatcggcatgataaacttagaaactcgttcaattcctttttcgactccattataaacaataagagccgttaacagcataaagataacaccaaaccacacagaggatggcgaagaaataaaggaagtaaaacaattatcatctactgcctgttttcctgaactaaacaaataaatagtaatatattttaaaatccatccaccaataactgcataataagtcataatcaataccggaacaaggaaagtcaagattcctaaaaatttccattttttacgcattgactcataagcgtaaatcgcactttttccggtttttcgtccgattgcaatatctgtagtcagtaaagtaaaaccaaaagtcaaaaccaatacaagatagataatcagaaaaagtccccctccatctttcgcagccaggtaaggaaacctccataaattgccgactcccacggcacttccagcggcagcaaatacgaatcctatctgaccgctgaatccacttttttgtttcattctctttcacctcatcttttttatttaacatttagatatcatgccattaaaacaatccagacctcatcagtcagtgtgttgatttgctacgccaaacagcgtctgctactccttcaccggaattttcattggtacattttatcattaaacactctttattgtcaatttctttatttcaaaaaatcctgtacattatctttcgtcactttttcataaggcaaatagatatatctttgattttcaaattccacttttttcattttttctccggtaacaagctgacgtgcaagctgtgccattgcatttgcctgtgcctctttatcattatataccgtagcggccatcttttcttctaaaacagcttctaaaccttcatctgtgccatcaattcccaaaaaggccggaatatcagtctctgtatagccgagcttttcataggcatcaatcgctccaagtgccatatcgtcattatttgccagcacaagttcaatctgattgttatattgattgatcatctgtgtcattcgattttgagcctgtgcccgattccagtttgcgatttcataacttagtttttctaattcaactcctttttctttcaaactgtcaactgcgctctctgttcttacgattgcgtcctgatgtcccatttccccttccaatacaacatactgaatttttccgtctttatttcgatcaaccgtttttcgttcccaaatcaaatctgctgccagctctccctgcatgactccggactgctttgcttttgctccgacataatacagtttctcccactggttcaaatcctctgccacaggctcccggttaaagaaaatgatcggaatatcactttcctttgccgcctcgataatttcagacggattggttcgatctgccagattcacacaaagcacgttacatccctctttgattaaacgcttcacctgatcattctgtattttttgtgaaccggctgcatcctgaaccgttacagatattttatgttgatttgtttccagcctgttgcactcttctttaaaacaggacaccagttcattgatatacgtatcactttgattgtacgaagcaagcccaatatttattttttcggtttctgttttttccggcattccacaggcacttaagccacataagcataccaaaaacacgaacgccagttttttttgtttcattttttcttcagcctctctttgttttcttactgactcatcttaaataacaattcctgatttttttctgaaaataaattttcttttcgaagcacagtataagataatactttgccatgcacacaatacgtcattttttttaaagcgtgtgagagttctaccagactttcatatcccacattaaattcatccggtacaagcaaacactctgcttctccggtatccagataatatgctgcctctgtcgagcagccaattccataaatcatagaaccataaatttcattttcttttaccgcttttcctgcctctaccagacttcgatcatctaacgcaaacagataatctaccttttcctgctgttttaatagctttgcatcttctcccgcttctgtcacccaacagattttggcatctgtttctgacaaagcatcctgtactcctttttctcgctttttaattgcttcagaacgattattacttaaaaaaattccgactttcttctgctttaattttccatcgttatcctttaacaactcttctaccagacgttttcccatttcataatggtccggctctgctacaggaattttggaagtgttttcaggcgctgccgaaagttcagaaagcaataacaccggtacctttattttttttaactgttctgcaagcgtttcgtctgctaccggctcgataatcagtgcatctgctcctttatcaatttcatgttgaatagcagacatttcctcttttgcagtctgaaactgtgtcggatttataataaatacatccacattttcatcctgtgctgccatctttaatccatacttaaaagccgaccattgcgtttcatctgaattttgaatgattacggaaattctttttaaatcctgcccttgcctcttttgaactgtaaaaataatcattccgatcagcaaacatcctaaaatgcattccactaaaataaacatttttttgctacttttcataaatttattccctgtcttttttctgtatttgatccttgctgaataaataacctttttcaagaatccgacgattttcttctgtatatacgattgcaggaatacgaatcaaaactgttgttccttcatcaagttcactttcgatttttaagccatactcttttccaaataagatttgaattctgttatttacattcgtaagccctactcccgaacctttcttgtgaactcgattcgtatccatcaaaagaaattcaatttcttcttccggaatcccaattccattatcaatcacggataaaatcaacgttccctcttcttttgttacctgaaccttaatttctccgtcctcatcttcttccaacaagctcattccatagttaattgcattttcaagaattggctgcagcgttaatttcaccgcacaatattgttccaattcttcatctacttcaaaagcaacctgaaatttatttttataacgcactttctggatattcatataactttttgcatgctgcaattcatcttttaagctgataatcgtatgcccttttgaaagactgatgcggaatagttttgcaagctgtgagatcataaacgtcgcttcatcgtttcgctctccctcaatcatccaggtaatcgaatccaacgtattatataaaaaatgaggattaatctgactttgtaaggcatccagctcactttttcgcctttcattttgctcccatacaatttcattcatcaacatttcattgcgtttataagaattttggattgacttacctaaatgccggatttccagagaaccaccaatataaatatccggttcttttccggcctcatgctctgataccgaatgattcaattttaaaatcggacttgaaattcgaagtgaaacaattcgattgacaagcactaacatcattgccattaacagcatcaacatcacaataaaacattgcaaattcgtcaactgatctgtgaaaatcgaatacggtatcacaccaactaatttccagccggtataactgattggacttacgattacctttctatgttttccctcgaagtattcatcataaatcatcttttgtgattttgcggccgcttcgctgctttcactgagctttccgtcactaatctgcatctgtctcggatgataaatgattttgccattactatcacataaataaaaatactgcccattttctaaggtgttaatctgatccatcatacgtgagatttcagaataatccatatctaccaacaagacacctttttgtgaatttacaccatttgtcaactccacaacacgacttgaagaaataacccaataatagcgaaacgttccatcatcaaataaattctggatatgtggaatcgaaaaatgtatattttccatttcatccatcgcatggataaaccaatcctgctttgtcacatttggatcctctttttgagatacgaccggctctgctgcaatcagacttccaaaattattataaattgcgatacttcttaatctacttttatttgcttcatataataactgcattcctttttgaatttcttctgactccgtagaaaaatcgctttcttttatcacactataataagctgcatcggaaatttgtctcatattcatcagataatcttccatgctttctttgctttgttccatcagtttttgtgtgcttttaatcatttcctgcctggataagttagagaaacgcatatacattacaattcccgtaagcagcatgattgaaacagaaataatagaaaacgcaaccataatcgtcgactggattccgcctggttttaatctctctaaatagtttgcgattttatttctcaccttttgcatactccgttctatatttcgatggagaaactccatattgtcttttaaatacataactaaaataatttgcgtcggtatatcctacactttttgcaatcatgtaacttttttcgtttgtttctattaaacgtttacatgctttttccatacgatactctgtcagataacccacaaaagaatttccggtctcttttttaaacatgctcgaaaaatacgaatttgacactcctaattcttcacaaatatcatccaaagaaagcccttcttctctataatgactttctacataggtttttgcttttgtgatcaacgactttgtagaagacgaacgggcatctgtaatctgctcccgaaaagagaggctcacttttaacaaccatttttttagtccttccggttctaaattgattaaaatctgataaatctctcccatttctccggaaaactctttactgctaatttcattattttcagaaaaacgatacaaggtactgattagttccattaatgcaacatgatgtttttgtagtgtctcagatggcacaaacaaatgttttaaataattttccacgctttcttctatttgtgcttcggagccaaggcgaatcattttaaatagttctaaaagttctccctcgcttgacacttcctggtcgacctgttttttcgggacaatttccttaatattaattgctctggaacttccatataatactctgtaggaaaccgcctcttttgccccttgataagattttgataattccagcagttcgttacaaactgccccaactccgatggtggtaacggcgccaagaattctatgcacatatttacaaaagcggtcacattcgtctgtcaattccgaaatctcactttcctgtctaagctgtacaattaaaacagtatttcctaaataagcaaagcatttcgctttccattttggtgctaattgctcttttgcctgcctttcaactgaaattgctaacaattgcggattcattccttccggcacccgattggtcgatgtatgaatcacgatgcagccaaacacaggcgcttcaaattgaatttgataatcttttaaatattgttctaactgttcttcataaatgcgtccttcaattaaagtcgaataaaagtttgcctgaagcagcggtaaggaatccatataatacttttgcagcgtttctacatttcgtttttcgtcgatttcctgatccaatttctgttttaattttgcaaatacttctgttagttcaatcgcatttaacggttttaagatatattcttcgatctccaagtgaacggcttcttttgcatattcaaattcatcaaagccggtaaataacaaaatttttgttgtcggatatcggcttttgatttcgccacaaagctgcatcccgtccatataaggcattcgaatatctgtcattactacatccggttggaattcctctatcatctcaagcgcctttaaaccattattcgcatgaccaattacgcaaaatccaagcttgtcccaatctatttttctttcaatcacttgtgttacttcttcttcatcatccaccaaaagcaagctatatgtattcatccgcttttctccatttttttaattttctttttattatacatgattttatgcaaaaaaagaatcctgcatttttttgcaggactcttccttttgtcttgattttttattattttttctgtacgtattttaagcagtccagtgttaccgctacaagaataatgatacctgagaatacgaactgaaggtttgtatcaataccaagaatagtaagagaataggtcagtgctgtaaagataaatacaccggttacaacgcctgaaattttaccaataccaccggtaaaggatacaccacctacaacacaggctgcgatggcatccatttcccatccctgtccatatgctgcggaaccggaaccaaccattcttgcacattccagccaggcaccaaatccataaagaatacctgccatgatgaatgcaccaagcataactccaaatactgagataccagaaactgctgcggcttccggatttccacctactgcgaaaagattttttccaaatgtggttttattccagataaaccatacaattgcaactgctgcaacagcccaaagaataatagttgggaaaccatttacttttggaatgatcattcccggaatagatgcctcaatcgcaccaaaggatacaccttttgttgaataagtaactaaaccaaagattacaagcatatttgccatcgttgagatgaacggatgcatttgaaatttcgctgtaaaaaagcctgcaattgtagtaaacaaagtacataagaatacacacacaactaatgcaaggaatactctgcctccaacagacattccggtaaagtcaaacacatgtccaaatactgtaccggtatttataccctgatgcatgataatggttgctgcagtcatacccataccaaccatacgtccgattgacaagtctgtaccggtaagcaagatcaaacctgcaacaccaagtgctaagaacattctaggagatgcctgctgtaaaatgtttaacacattgttataagttaacagtggagtaccttttttaatcggagtaataatacacagtgcaacgaatactaagataattgcaatatacaatccattctgtaagaagaaagaacgggtattaaatttgtatttgtagttttcccatttctgctctctggtctctaagaaagtaaattttgacaaacgaagcatatcaattaaatgatatttataactaaatgcttcatgtttttcgtctttaattgcctgatactctttctgcaactctaattttgcattggataaacggttcttataaacgtaattttcatctttaatttctttttgctcttttaatccggaaagaatttctttatgctgtctctctaactctgcaactctttctttatagtgttcctgagcctgtactttttccgctgcacaactttcttttaccggtgtgtaatactctttatcaaaatgagcttttaaataattttctgcatctgcaattaattttgaaatttcatctttatttttattttcaactgcttttgctttttcaagttcaacctgatactgtgaaattcggttttcacgttctccttttgtaagagtacgatcccttttgattccatcaataacattttggtactctaatacctttgcagtaccatcttttctaagtacatcaatttgtttttgaattttaccaacatattcgtcaattggctgacgaagtttcatcttatcttctgatgtaagaattttactatttgccatatctatcaatctccctttattttacagatacttcgcactcagtctcaaaagttcttcctgattcgtctcttttgtatttacaattccagaaagacgtccatttgacattacgccgattctgtttgtaattccaagaatctcaggcatttctgaagaaactacaataactgtttttccttgttttgccatgttaataatcagctcataaatctcatattttgcaccaacatcaattcctcgtgtcggctcatccatcataaatacttttggatctctctccaaccattttccgaagatgactttctgctggtttccaccggaaagacttgaaatcatatcatccggtcccatacacttggtatgcatagtcttgatttcttttgatgttgctctgaccatttttggatcagaaagtgcaactccgtttttatatgcatttaagttggcaatggttgtattaaatgtaaggtctccttttaaaaacagaccatttgctttacgttcctctgtaatcatagcgaaaccatgctccattgcttcttttgcactattgaaattcatcaactgatggtttaaatagacacgccctgctgctcttgtccttacaccaaaaattgtttctaatagttccgtacgtcctgcccccacaagtccgtacaacccaaagatttctccttctcttacatcaaatgtaatatcatcaagatgtggctcaaacttcgttgacaaatgctgaatcgataacacaacatcttttggaacattgtctaccggtgggaaacgattttccagtacacgtcctaccattgaagcaatcaactcattcatgtttgtctcttttgaactctttgtcataaccagatttccatctcgaagtactgagatctcatcacagatttcaaaaatctcatccatcttatgcgaaatgtaaatcaaagaaatcccctgtgattttaacattcgcatcatttcaaataatttattaacttcttgtaccatcaaggatgaagttggttcatccagtacgattactttcgcattataagaaattgcttttgcaatttcacacatctgtcgctcagataccgacatatttttcattggctgatctaagttaacagtcattccaagctttctgaaaagttcagatgcttctcttttcattcggctttcatcgatcattcccattgaattgaccggatagcggccaaggaataaattatctaccacatttctttccaaacactggttcaattcctgatgaaccatcgcaattccattttcaagagcatctttcggtccggaaaagcttacttcttttccatcgagaaaaatacttccctcgtctttctgatatgtaccaaaaagacatttcatcattgttgacttaccggcaccattttctcccataagacccattacggttcctcgtttcacatcaagattgatgtgatccagcactcgatttcggccaaaggatttactcattccacgaatcgataagacattttcttctctcttatctgtcatattctcactcctgtaaacattcgttagcgaaattttagggggaagtactcccccctaaaacttacttgttttcattccttttttttacatttaaattactgatttaaaattgcagtataggaagctgcgttatctgttttaaccatgttgattgcaaatgcatcatactggcttggatttcctaaacggtttgtgatattagattctgtctgtccatcacctgcaatatattcgatatccagatttaagagatcatcatatttctgaagcagtggctgataagtagaacctaagaagttatcaccagagttatagatgtttaaccatacttttttagatggatgtgcagattcatctaactgtttagatactggttcccaaacaactgtagaatctgtaaagtctgtgtagttgtctgctgtaaccgctacgtttaatgcatagtaagaacgttcgtcttctttgtatgtatatacatcatcacttaatacgtttcctgcatcatctgcggttccgatacctgtatcaatatcaacaccgtctaatgagttacgcagtacacgaagtgttaaataagcctgtacgtctgcatgctggctgattgttccgccgtatccttctccgattgcagcaactgcatcgctgtttgcatcatatccgaatgtaggaactttgttatcttttgaccatgcattgaacatagacattcccataccatcgttgtttgaaacaacaacatcgatgtctttaccaaaagaagaagaccatgtaccgattgcattacctgctgttgcagcatcccaggttgcacctgcggagtttttcatttcctgagaagctaactcacgtacaacatattcttttccgtttacttcaatttttccatcctgtactgctgttgcggtaccatcggtatttgttccaaccggagcactatctacttcaccatctttttcaactgcggttccaagagctttacgcacacctcttgtacgtgcgattgagtcattatgtccgatatctccgactgccaaaacataaccgattactccatctccgttacggtcgattttgtcaatatttttctcaatatattcttttaccattgttccctgaagttctgcaccctgatttgcatcaaaacctacataataagtatctttgttgaagtttaatgcagttgtatcaagttcacccgttgaactgttagatggctgacggttgaaccatactaaaggtttatctttgtttgctacatctgagcttgcctcagcgccggattctgtttttgcatcatctttctttgcactgtcaccagagtctcctgaaccacatgctacagttgaaagcgcaagtacgcttgccattgccattaacgctaattttctcttcataattttttctccttttcatttttgctcaagtgttttgtttatgttgacagtatatcgtttttaccataaataaactatagaatatttttgggtcttcattaaaatttttaggataatcttcgttattttgaccatttttcatcttatgctgacgcagtttcttacaaaaaaatatcgccagccacaattatgactgacgatatataaattcatttttatttttttgttataatcttgctacccctgtttttctggctgcttctgctactgcttttgctactgccggaccaactcgtttatcaaatgcttttggaataatataatccggatttaattcgtcatcggtaattaaaccagctaatgcatttgcggcagcaattttcatttcatcattaatgtctttcgctcttacatcaaatgctcctctaaagattcccggaaatgcaagtacattattaatctggttcgggaagtcacttcgtccagttgcaacaacctttgcaccgccttctttggcttcatccggatagatttccggtaccggatttgcacaagcaaaaatgactgcatctttagccatgctctctaccatttcttttgtcaccatcttcggcgctgatactccgataaatacatccgcaccctctaaagtttccgcaagagaacccgcttttttctccagatttgtaattttgctcatttcatttttgactggattcatgccatctgctctaccttcatagattgcaccatggcggtcgcataaagtaatatttttatatcccgcttttaataataattttgcaatcgaaattgctgctgcgcctgcaccattcattacaatttttacctgtgatttttcttttttcacaagcttcattgcattatttaaaccagccagtgtaatcactgctgttccgtgctgatcatcatggaagatcgggatatcacatttttcttttaattttctttcgatttcaaaacatcttggagccgagatatcttccaggttgactccgccaaatgaaccggaaatcatatagatggtattaacaatttcatccacgtcttttgatttaatgcaaagaggaaatgcatcgacatcaccaaacgctttgaataatacgcattttccctccataaccggcattccggcttccggtccaatatctcctaaacctaatacagccgaaccatctgtaacaactagacacatattccatcttcttgtcagttcataagatttttcaatatctttttgaatttccagacatggctgagcaactcccggtgtgtaagctaatgacaaatcatcttttgtttcaaccggaacatttgctacaacctgaatttttcctttccactctttgtgtaatcttaatgattcttttgcataatccattttcgtttttctctctttctctaattatttttaataatttccttcaaagaatctactgtctttttgtaactgataacccttaaaataactattaaaatccaattttaagtattcacagagatttgcaagttctgccattgtattatcgttgacctgaattccattttccagacggtctttttttgccagcacttctttttctccgtgtgtataaattcgttctgctccatctgcttttggactttctcttaatgcttctaggtattcagaaaaatgtttcttaatctcctccggatttccaaaaattgccgggttcactgcaataaatccatggcagatacctgttttatctttaaaagtgcaacatttatcagaagtgacaccctgtgataaaatagaactaaataattcacataacattccgtatccgtatcctttgtggcttccatttacttctttatttccaccaagcggcatgattcctccgcctcgttttgctacaatatttgagagtacatccggtgcatctgtgctttcttttccgtctttatcaagtgcccagccttccggaagtggtttttccattttattatacatttccagttttccacgggtcacaaccgttgtagaacaatcaaataaaaacggatacggttctgccggcattgccactgcaatcggattggaaccaagcattgctttcttaccaaatgtcggaaccataattgcctctgaattcgtgcatgccataccaagaagtccttcatcactcgccatctttgcataataaccggcaattccaaaatgattggaatttcttacactaaccattccgattccggatgtttttgctttttcaattgcttttttcattgcataaatggaaatcagctgccccattccattatgcccgtcaatcacagctgaaaccggtgtctcaaatacaacttccggtttcgcaagaggatgaatggttcctttttcgattcctttatgataacgtaccatcctctgcataccgtgactctcgattccaaataaatcagcggtcaaaagcacatcctctatctctttgctctgtgtttcatcaaatccaaatgcacgaaacacatcatggcaaaaatgttccagtactgaataactccattttacatatcccattgttgctcctcctttggtattccgtattatatattggtattgccaatttttaaatgaagtataccaccattcttttcttttttcaaccttttttccataaaaaaagaagaaaacttttttaaaagctttccccttttttctttcgatattctcattgattctcctgcatcatttctgcacgttcttcaatatatttttctatatttatcatatgttcctgcatataacgcactgctgattcttcatcatgtgcaataattgcgtctaccagtctcttatgctgttcatcaatttctgtaaccgacatttgtttctgcataatataagcacgaattcctgtaataatattttctgtcagctgggaagctgcactcattacattaaataacattggattatttgccatttttccgatctttatatgtaaatctctgtccaaatctcctcttatctgttcatcttgttctacctcaagttttgctaaaatcaattttaattccgccgcatcaatcggagaacaatttctggcagccaattttgcacattggatttcaagtgcggaacgaagctgctgattttgctgaacactgctgttatttaactgtaataaaatcgaaagcggaccaatcatacaattttccaaatcttctgaaatataattcgcccctccatgaaccgtttttataattccaagaagacttaaagaccgaagcacttctcttataaccggtcttgaaacccccattgcttctgccattgcacgttctgccgggagcgcatctcctttttttaatctgcctgctctgatattttcgataatctgatttaaaatttcatcaaacgcattttctttactaatctgcctgaacatatttctttccttcctaaaaaataatgcttttctttttcatcctttttttattatacgtcttttcattttaagtaacaagctgaattttatagcaaaaagaaaagcctacgaagaaaatttctcccctacttttgtttgattcaaaggtaggggactcctcctgatacaagcaaatccccacccactgcttattgcttttcgcaattgaagcaggggacttacttgattcggttaaataattgctttatgttttcttctgattacttcaagaatcacaagtgtaacaatgacaccaaatgccagtgatatccatgcattttgtgtgaatcctgctaccacataggttacacagctgattgccgcaacggtaagagcatatggcagctgagtagaaacatgattcacatggtcacactgtgccccggcagatgccataattgttgtatctgaaatcggagagcaatggtctccacaaactgctcctgccatacatgctgaaatggaaataatcataagctgtggatttgaattctcaaatacatgtacaacaatcggaatcagaattccaaaagtaccccaggatgttcctgtcgcaaaggcaagtcctgctcctactaaaaagatgattgccggtaaaaatttcataaaacttccggcacagccctgcatcacagtatccacaaactccgctgcaccaagactgtctgtcattgcttttaaagtccaggcaaatgataaaatcataattgccggtaccatcgctttaaatccttccggaatacatcccatacattcacggaatggaagaattcgacgtgccacataaaagataatagtaattaaaataccaaacatacttccgattaccagcccgacagaagcatcactctgtgaaaaggcagttacaaaatccacgccggagaaaaatccgcctgtataaatcatacccaatacacagcagacaacaagacttaagattggaaataccaaatctattacttttcctctctgtgttacggtctcattttccgctgttgcataaggacgagctgatgtagtataaatatcaccattgattgcattgtgctcatgtgttctcattgaaccaaattcagcttttaataaaaccattccaaccatcataaccagcgttaacaatgcataaaaattatacggaatcgcttttacaaaaatcgtaagtccatcttcgccctcaacaaacccactgactgccgctgcccaggatgaaatcggagcaataatgcagaccggagctgcagttgcatcaatcaaatatgctaattttgcacgtgaaatattttgtttatctgttaccggacgcataacacttcctacagtaagacagttaaaataatcatcgataaaaataagaacaccaagtaaaatggttacaagctgtgttccgatacgactcttgatttttctgccggcccatctgccaaaagcagcagaacctcctgctttattcatcagacatacaaccgcacctaaaataacaagaaagattaagattcccacattataagaatccgatataacagaaataaatccttcctgaatcatatggacaacggttccttcaaaactaaagttcgaataaaacaatgctcccactaaaattccaataaataaggaactgtacacttcttttgtaatcaatgctaacacaatcgctacaatcggaggcaccagtgcccaaaaagtagcatacattttcggcacgtattctgctgcctctccatctgcggcaaaaactgtcaccgcacagaaaaaggtcagcatgagaactgccatccctcctgtaagcagtttttttcttacgcttttcataaattttcctctctttcttttggaatgtactccataagagtacatttgatttctttatttaccggactttgtaacatccaagtcgaagattaaaacaaaagaaaaaccatgaacggtttttcttcgcaaagaacccattcatggtttttattcaaaataaccctgagatagctctccacattcgtgacagtataatgcatcttatccattatcccagagattgtatttttgagtgcaaatccatcccttcggcagtctcccctttcttgtttacctgtcactcaccatctggtaaaaaatactcttgaagcccgcacctctatcttttcctctttttatctttttatccggcttatgccagaaatctttttctttaacaattatactataccatcttacaaagcaaaatccaatacttttcgacaaaaacttttcgatatgcgttttacacaaattatattgtataaattccaaaattatgttaaaatagtataaacaaaattcggattcattctatattttttatgtattctgaaaaatttttgagatattgtatatgcatttaaggaggggtttttatgtcaaaacaggtaattacaattaaccgtacttatggcagtaatggacgtctgattggaaaagcactttcagaacgtctaaacattcctttttatgacaaagaattaatcgaactggtcagtcaggaatgtaatattccggcaaaagaattagaaaaagtagatgaaaaacgcgcaaatcaatggcatcttcctctaaaagaagcaatgcagatggaaccacagtatcattttcgtcctatgaacgacgtattgtttgatgcacaatcgactgttatccgtgaccttgctgaaaaggaagactgtatcattgttggacgctgtgcagattacgtgcttcaggaaaagaaaaactgccaccgggtctttatctatgctccatttgactaccgagttcaaactgtaatccatcggctcgaccgcaacgaaaccagcgccaaacgacttgtcaaaaaaatggataaagaacgccgttattactatgaatattttacagaccgcaagtggatggatatgaaccattatgatttatgcatcgacagcagtaaattttcagaaacagccatcttagatatcttagagactttgtatctaaaataattaatctccgtgagctaataaccgaacttcttaacttaaaagggagtgtcagactggcactccctaaaagcatcatcattatttatttttaattttagttattttatttttgtaaagcatccttaaatttttaccactctaagagcactgctccccaggtaagccctgcaccaaatccggaaagcaccagtttatctcctcgatttagcatcccatttcggttcatttcatcaagcagaatcggaatacttgctgcagatgtatttccatacaaggataaattcattggaaacttctcttccggctcttttaaacgttttgcaacagactgaataattctgctgtttgcctgatgcagaatataataacggatttcttctttttttacttctgcttttttcagaacttcttccacacactccggcaccgtctttactgcaaatttaaaaaccggttgcccttccatatacaggtactcttttgtttctgattcatgattcagcaaatttctggtttctcttgccttacagcttaaaactccttttcctgccccatttgatttctgaaccagttctaacacccctgtctcttcagcactgacaaccgctgctcctgctccatccccaaataacacacaggtacttctatcactccagtctatcatttttgacatcgtttctgctccgacaatcaacgctttttgatagattccaccttttatatacgcctgcgcagtacttaaagcaaataaaaaccctgagcaggctgcacttaaatcaaatgccacagcatgctttgcaccgattgcctcctgtacctgacacgctgtattcgggaaaaaataatccggtgtacacgttgccacaataataacttcaatttcttccgcagtgacacctgcattttctaatgctctttttcctgctaaaattgcaagactcgttgtgttttcttcttttgcaacccttctctctttgattcctgaacgactgctaatccattcgtcactggtttctactatcttagataaatcttcatttgttacaatctgctctggaactgcacttcctgttcctataattctggctgtcattttatttacctctattttcaaatattttgataatcaaacaatatatagcaagtatacaaagaaagagattatttgtcaacacaaacaacctcttctcttacgcagtcttattcactttttttatttcttctctcttggttcataaattttcctgatttcctgtgagagttcacgatttaaatcatctaaatctacaactgagtgaggctcataattggaataactgtttttctgttcctgctcttttggctcgtcctctctctgattccggattcttctataagaagaatcctcttccttggaaattcctttccggtttggatttccttttttcttattcgtagtcttattatcctgctttgttactactttattgttagtctgataaaccgtttttttcttttttttctttcttgatggcagggatggaagtgtcggaagtgaaaaacttcttgggcttctttttcttctatctgaaaatctgtctgacgaaaaacctctttctcgactttgtttgcgcagataaggtcctgcctgtattacaataccaaatattccaagaatcagtcctaaaagccagaccgctgcattttcctgcattttagaaagttcaaacaggcattttactgctccaattccgccacacagaccagtaattacaatcactacatgtctctcatatcctaatgccatcgtcgctactacaattccgactgccagacagataatccggcttgtcacatcttctcctgaaataaaggaagaagccaaccagtaaatcaatccggtacaaagaataaaaatacctgctttataaaagcaccaggctatcatcccaagaaacagcgcaaccaatgctccggcaattaaaatataactctgttttcctccaagataataccatgctgccgcacctccggctactgctccgattgccagtcctaaaagagttccccatacttttctaagccgatatcccataaaacagtttagcagtgcaaatatcattcctgccagtaaaatccccgtcatatatttctgtgttatattcccatattctgaaactaccatgtttaatatctgtgttatattcatctctttctaccacctctcgcacctacctaccttaacacacatattttaacttcttaagttcattaatgtgaattttttatttcttttcctttaagatatgaattacgaatgtaacataatgtttctttttcacctttttctgccaacattcgtaataaaaattccaaatcacggtttgtatcctcatgcacaaaccacaatttacccttgcttttcaaaaaatattctaaaggcgcacggttcgtataagattccggatgatacacttttgaagcacaaatcctgtccatcaccatctccgctatataattcctcggcatcggcactccttttataatggtatcacaatcaatcccataatctacccaatgttcaaaatgatgtttatttcttccatagtgatgaatccacgctgttgaaagccctgttgcttctctctccgcattgtttggactgcggtttccctgataatatttacatcctgctgaaaattctgtccatgaatactttgacaaatcatggagcattccctgccgatatagtcctattttaaagcaatatttcataaccatcagtttatgttttgtaattgttttaaaatgtccccagatatgcattaattctcatcctgctttccttttaaaattactacggttcttggtccaacctttattgttactttcttcttttgaatttcttttttctttttatttttttctgtcttttcttcttttaaaatttccgtttcaatctctgcgtcttcaccacttgtcagaatctgttcccatgacattttttctgaaagacttggcagtccaaattcatgttcattccagtgaaaattataggctgcaaagagcagctctttttcacatccggcataatcttcacagtatagaattcctatgtgacggtactgcggacttccggaataataccacggctgattactatgataagaaatatccggatatcccacagctttataatctgccccttttaattcgctttccagatgcaaaatcgaatgcatttttcgaatggaaaccgcttcttttacaaattcaaacagttctttattctgacgcagttttttccagttcacccatcctgtttcattatcctgacaccatgcattattgtttccgccctgtgagtttccaaactcatcaccctgaaaaataagcggtgttccctgacttaacaacaacataagaaaagcgtttttcaactgtcccatgcgaagccggcgaatacttttttttctgctgtacccttctgccccacagttccaactgcagttatactcaattccatccctgccattttctccatttgcctcattatgacgttcatcataagagaccatatccatcattgtaagaccgtcctggtctgccatataattaatcacaccactgtttttgtaatttcttttatttcgataaagaaattcttctatcattccctcatcactttttaaaagatgacgcatacaatataaaaatccatcattgtactctgcaatatgccgaaaagacggaatctgtttttgataaatctgctctgcattaatatcagaaaaaaataatttactctgtgaaagccatttatcttttaccaaaacttccggcaatacgccctttcccatcagatgaaatccatcaatatgatacgttttcatccaataatgcagaatatcaagtatctgtgaagaaccgacacttccatcaaaataaaactccatcaggcactcaattcctgcaccatgaagcgaatccaccatcttacaaaattcctgatatggataatcggtactgcaaaaagaggcctttggtgcaaaataatttgcttctccggtatagccccagcaatttacccgtacctgtttttttctttctccaaagcgttctggttcttttacttcttttgaacattcccgatactcgtaagccggcatgaaaagcacacctgtaattcccagcttttttaaataagcgattttctgctctactccacgaaatgttcctttctcccttactccggaatccttatcttttgtaaaaaaacgaacctgtaatttatataaaatactgtctgagagtaaaatcggagaaaatttttcttttttccagtgataattttctttttgataccgacatcttactgcatgttcttcttttggatattcttttccaaattcactcactccgctcaaagaatgtgcataaaaatcctgctgcacttccccatccacacagtagttatactcatactcatccatcgaaattccggatatcataactgcccgatagtcgccaaaacttttttcttttgaaagtggaaccgctatctctggtctgctttccccttttttataaaaaagcagacttacttctttctctgcttctatacatgctgtaaacacatatccttttcttgtttttacgacacccggactttccggataaacaactctccactgcagtttattttccgtctcactcacacattctctggacaagcttttcacctcatttcaatttttcctgttccttacacagcacttccattctgtcatgtacactcgaagcatcagactcatcagtcattgtgacaatcgtatccccattcataagaatcgtatgtccctttggaatgagttcacttccacttcttttaattgctactaacagacagttttttggccattctacctgctgtatcattttattttgaatttcacatccataacttacaatatattcctgtaaaaccttttctccggtctttttcgaaactttgattcctcgtttctttaacaaattggtaagcagactttcataaatcggttcggatttaaatgccgtagccaccagataagcgacaattgaaaccaaggataacgacagcatctggctgaaacttcctgtcatttcaaaaatcagaatgattccggtaatcggtgctcgtacaattgctgtaaaataaccagccattgccagtacaataaaattgctgatatactgtgaatccatcccaagatatgtgactgcaaaagaggcataagcgcctccaattaaagaacctaatactaaaagcggaaagaaaattccgccaggtgctcccgaaccaaaagaaacgcatgagaaaaataacttcatcacaaacagaaacaggattccctttaacatcatattgccttcggcgaccatatcaaccagattatgtccgcttccaagaatttccggcattgtaaatccaaaaaatcctgccatcaaaaacggaattaacagtcttatcgtctctgatcgttttccttttatttttccaaacaattcctgactctttaacgttactttattataaaaagcacccataatacctaaaataattcccagtgctatgatatgtccataatatgaatcaggaattgctcctgtcacctcaaactgaaaaaccggacgaaatcccataaattccgccgaaatataatctgcggtaatcgacgctgtcataacggaaatcaagaccgacaccgaaaagtttttatgtatctcttctaatgaaaacatcacacctgcaagcggtgcatgaaatgctgcggcaagtccggcacttgctccacaggtaatcaaatatttttcttctgtttttcctcttccaagcaggctcgaaaccgcttttcctgacattgctccaatctgaatcgacgggccctctcttcccaaagaaagacctgcaaacaaagataaaaaacctccaagaaattttgctggcagaaccctccaccagacctgatttaattttcctgccatttcaccttctacctgtgggattccacttcccgaaataaaaggttccttttttaccagccatccaacaatacatgccagcgtaaataagataaaaaaccagactcctgctgcaaatggatactctcttcctaacgcaagcacaaaattcatgacttttcccgcatattccaaaaggacacgatacgcaagtacaatcaatcctgctacaactccaactaaaaagccttctactgtcaagattgatttaaaatgtgcagccctttttatcaaatgagacgtatcttctttcactttctcttctcctctctcatccgtaaatgtgctcttaaaatctttccagaaacattaagagtacatttagagtaatacttttattatacgtgcccatagtaaaaattgcaattgccaattgtcaatgcttgaaatctttcaagtcatctggtactattaatataacactataagtattaagaaagaggtaattaccaatgagtgaagaaacttttacaaccaatatcggaggatgtgacccaagtgactgtgcgtcctgtacttcagactgtgccggagccggacaggcaattccacgcgttccaaatcctaccattaagctgaccttagaagacgattccgttttagaatgtgccgtactgactacttttgatgtagaaggatttggcgaatacattgcactgattccattagataaaaacggcaaaaataagagtggagaaactttccttttccgttatcatgaagaagacggaaatcctgttatcaataacattgaacgtgaagatgaatacatggctgctgctgaaagcttccaaaactttatcgaaaatcttcctcacgaaaatgaaatagacgaagagctggaggaagaaccagacggaaaacaaagtgaagaacaggatgaagatatttttgccgaataaaaacactataatatgcagtctcatcaaaccccaaaagtttccgagactacattcattttaaagggagggaatactttggaacaattacaaatctgggacagtcatgttcatttatttccaccggaaatttataataactgggaaacttatgctgcccgcgactcgtggtttggcgttctgaccaaaaagccggaaaaccacaaaggaaccgaagaagcctgggccaatgccgaagaagcgcttgactgtgccacacaagccgggattcatggtttagtcatgcagggatggtactggaacgatgcgggactgatgcgtatgcataatgactatatggcagaaagcatgaaaaatcatccagaacgcttaaaaggattcatctcaattaatccaaaattcaaaaaagaagccattgcagaaatcgaacgctgtgccaaactcggcttctcaggaatcggagaacttggtcccggcggaaacggctatgattttaatgactctgattttatcgaagtcgtagaatgcgcaaatgcctatcatctgccaatcaatatccactgcggagagccggtcggtcatccttatccgggaaaagacatgacctcccttgcgccgcttcctggcttaattttaaaatatccagatgttacatttattttagctcacatgggtggtggacttcctttttatgaattaaatccacgttatcatggaaagttcaaaaatgtctattacgatacagccgcaaatccactgctttatcacatcagcagttttcgtgctgttattggtttgattggaagcaaacgactgctttacggaagtgattttccactgcttttatatccgtctaaaaacagagaaatggatttttccatgttcgtcaaccaaataagaaacgatgcctgcctttccaaagaagaatggaatgatgtgatgggtaataatttacgacgcgttttagatatttaaacaaaactatattgaatccgaaaaggaacgcatgctgcattttaactgacaacatgcgttccttttcttatcttattttttttatttttctaaactcggaattgcaacttctaagtctacatcctttgcatagtccacaccatcaagatgaaatccaaacatctgataaaaatcctgccaatatccatcaatatctgaaagttctgctacattttctgttgtaacgttcttccagcactccattactttatcctgaacttcatcggaaagctcccagtcatccatacggattcttccctgttcatctgttaccggtttttctacaaataatttttcatgaaacaatcttgaaatctgttcaatgcatccctcatgcgttccctgtactttcatcactttatagagaattgcaaaatacagcggtacaatcggaattgctgcactcgcttgtgttaccagtgctttattgacagaaatataagccttaatatctgaatatttctcattgattttttctgctgtctttgtcagatgacgttttgcctgaccaattgttccatcataataaattggataagtcagtttcggtccaatataagagtaagctactgttacggcattttcagaaagcacacctgcgccgtgaagtgtgtccatccaatccatccagtcttctccgcccattactttaattgtaccttctaattccccatctttcgcaggttctacggtctttgtcacaattgtattatttcttaaatccagacttttttctgtaaatgcttcgccggtcgtctttaaggaagaagcccataccgttccatctgcagttgttcttctaggtgctgccagactgtagattaccatatcaacctgtcctaaatcttctttaatcatttcaacgactttttcttttacttctaaagaaaacgcatctccatttattgattttgcataaagtccatttttttcggcttctttttcaaatgcaacggtattataccatcccggagttgccgtacgttttccatttgatggcttttcaaacatgactccaattgtggaagcctgacatgcaaatgcagctgtaatacggcttgcaagaccatatccggtcgatgctccaattactaatactctctttggtccttctatcgttcctttatcttttacataagcaatctgtcgttttacgttctcataacatcctgtcggatgtgcggttgtacaaataaactctcttacctttggctctacaatcatcttattttcctccgccattttccttttcttctcaaatagtttgattctcaaagtatattatcataaaaaaaaaggaaatgcaaggtttgttttttacttctttcactacccaagcataatttccttttttcttaacttgttacaatttattactgctatttactgtcgcatttatttgttgtacttccaaatccaccatttctgatttccactacatcatcatccactgtgattccatattccacgaaaatgccctgtgcaaatccagttccggcttccacattgattactttgccttcgttggaatcatttgtaattttaataaacatatgaccctcattatccgaataaaaataatcgctgtcaataattcctaccgtattatttaactgtaaacgatatttaaatcccagaccgcttctcgggtaaacttttaaaacccagccttcttccatctgtacacggattccggttggaatcttaatcgtctcctgtggttttaactcaaaagtaagcgggctgaagaaatcatatccggcgcttcctgaagtcgcacgctttgggagcttaacagattcatagatacgttctaattcttcaccggaaatctcaccaaaggtatcctgccatccctccgcaaactgttctttactgactttcataaattttgcaattcgtttcataacgatttatccctccgcatgcagaataatctgcttttctttcaatgatttttgtacatcaatcactctctgattagaacttcctttccatttgagtgccacatttttcttctctatcataaattctccgtctaccagtacatccagataatttaagatttcttcgccttgcaaagactcccataatgcacctgtatacaaccagattgtcttggacggatacttttctttgatttcttttgcaagttttgttacctcagatatattttgtacataaagcggatctccaccggaaaatgtaattccggaaatataggctttttccagttgttcaaaaatctcctgcttcgcagactcatcaaataaaattccactgttcggatcccaggtcacaggattctgacactctttgcaacaatgagaacatccggatacccataaaactacccgaagtccgtctccatttaacatatcatcttttgtgatattatgataacgcatttttctgcctcccgtaaatttaatgtactttcggaatctttctgtgcttgattttgtgagaagattttttgtcaggtatgcccaaatttttgaagcgtacgtttaaaaagggagaaccgcttatcgccatgttctccctctctatgttacttagtcctgacttaaatttcttatgcttcttccggaacgtccttaatactgaagctgattcgtcccatcttatcttttccaagacagattactttcacttcatcacccagagtcagcacatcttctacacggttaattctttcttttgcaatttttgaaatatgaaccatgccctcttttccaggggcaaattcaacaaatgcaccaaagtcttttatgctcaccactttaccggtgaaaatctgaccttctttaaaatcagttgtaataattttgatgtaattgagtgctttatccatcatttctttttctgtgccgcatacagaaactgcacctgtctcatcaatatcaatttttacacctgtttcatcaataattgcattgattgtttttccacgctgtccgactacatcaccgattttatccgggtcaatctgaatctgaacaattttcggtgcatatttgcttacttcttctctcggctttgcaatacatttttccattacttctgtcagaatgtattctcttgcttcttttgtttttgcgattgcttcttcaataatcggtcttgtcagtccatgaattttaatatccatctgaattgcagtgataccatcatgagtacctgctaccttaaagtccatatctccaaagaaatcttccagaccctgaatatctgttaaaacaatataatcatcgtctgtttcaccggttaccaaaccacaggaaatacctgctaccggtttcttaatcggcacacctgctgacatcaaagacatcgtagatgcacagatacttgcctgtgaagtagaaccatttgactcaaatgtttcagatacagtacgaattgcataagggaactcttccggtgccggaagaaccggaactaaggctctttctgctaatgctccatgaccgatttctcgacgtcccggacctcttgacggttttgtttcacctacagagtaggacgggaagttataatgatgcatgtaacgtttggatgtctcaaattcatccagtccatccagtctctgtgcttcagaaagcggagccagtgtcgtaatcgtacaaatctgtgtctgtccacgtgtaaacattgcagaaccatgtactctcggaactaaatctgtttctgctgccagtggacgaatctgtgtgattgcacgaccgtctggacgtttatggtcttttaaaatcatcttacgaaccgtttttttctgatactgataaacagcttcagaaagtacagccagccattcttcattttctgcaaatgcttcttctaatttttctgtgataacacggatattttcttctcttgtctgtttgtcatcagagaatacagcctcttccatttctgcaggaggtacaatctctttgattgctgtaaacagttcttccggaacagcgcagctttcataagcatgcttttcttttccacattcagcaacgattgtatcaataaaagcaatgatttcctggtttacctcatgtgctttaaagattgcatcaatcatttttgcttccggaacttcatttgctcccgcttcaatcatgattactttgtctcttgtggaggcaaccgttaactgtaaatcagaaattgttttctgagccagtgtcgggtttacaataaattccccgttaatcataccaatctgtgtcgccgcacatggaccatcaaacggaatatcagatacacatgtcgcaatagaagagcctaacatcgcaacaacttccggattacattccgggtctactgacataaccatgttatttaatgttacatcatttctataatcttttgggaacaatggacgcattggacggtcaataacacgagaagttaaaatcgcatgctcacttgctttcccttctctcttattgaatcctcccgggatttttccaactgcatataatttttcttcatattctacactcagagggaagaaatcaattccttctcttggtttttcagaggcagttgctgtacacagtaatgtggtgtctccgtaatgaataaatgcagcaccatttgcctgctttgctacacggttgatatcaactgtcaatgttctgcctgcaagttccattgaaaaacatttgtactctttggacatctcttatctccttttctaaactaatctggcagcttctgtccgaaacaactgaaaaaaacagttttatttttacacttataacactttacttttcttaaactgttcttttcagtggtctcggctccagttttgccgcctttgctaaaacagggcggaaaaattccgcccctggttgttactgattattttctcagacctaatttttcaattaaagcacggtatctttcgatatcagttttcttcagataatcaagaagaccacgtctctgacctaccatttttaacagacctcttctggaatgatggtctttatggttgctctttaaatgctctgtcagctcttcaattcttgctgttaaaactgcaacctgtacttccggtgaacctgtatcacctggtgttcttgcgaattctgccataatagcctgtttcttttcttttgaaatcattttaatttcctccattcatctttttaatcgcctgtaattaagaaacggtcggagtgtccggtttctgaactacggctgaactcatacttgctcagtatagcacaagatatttcacttgtaaagtcctattgtgttacaatttttcatgtaaatctgcaaaaaattgtcttccttttgccatatcaatatcaagctgtccctttaattccagaagggatgcaaatttacgttccggacgcagataatgataaaatcttacttctgcttcctgtccatataaatcttcattacaattaaacaaatatgtttccacacccagaaagttttcttttaccgttggtttataacctacattggagattccatcgtactctttttctccaattttagaacgagtcagataaactccgtttggcggaaattttttgctgactggcggaatcagattcgcagttggtactccaatcgttcttccaagctgtcttccatgcacgatctctcccctggtaaaatactgatatcccaaaagagcatttactttttcgatgtgtccctcttccagctcttccctcacataagtactactgatttctcttgtcccgtctgtcagtttttctacgacttccaccgtaaaatcatactgtgttcccatctgttttaataactcagggtttccttttctttcgtgaccaaatcgaaaatccggtccaaccgccagataagatacatgcagacgtttcaccagaaattcttttacaaattcttctgcttccatattcatcacagcatccgtaaacggacacgcaatcaaaacatccactcccagattctctgccagttcctgtctttcctcattggttaaaagagtctttgccggtttatgatacagcttcacaagaggagaaacatcaaaggtaaatacgaccgttgtacagttttcttttttcttttgtttcatgcacgcaatcagtttctgatgccctctgtgcaatccgtcaaattttccaagtgtcacagcacttctctcttgcgctttcagtacaggcacttcgtttgtgtaaatcataatgtctcctctttctgcttctaaaaatcctgcggtgtaaaaaagatggtgtgcactccaaaacattcccgtcttttttgatactcataaataccgataaaatgtctgttgctgtcatacatgcgcactctcgttttatccggcaggttctgatgtgttattgccggtactttatttccattatgaagcagtttatccatttctttcggcactacaacctcttcataatgagaaaacatttcttctattgttacaagatgagtatcaaatgtccccgcttttactgcagcctcaatcgcagaaagtttcatgctgtcttttaacataaaacgttctacctgcgtacgcagaagagattccatacaacctccacagcccagtttcgcaccgatatcatggcataaggttcgtatgtaagttccctttgaacacgttactgaaaaacgtaccaatggcagattcatttctaaaatcttgatttcataaagagttacttttcttggttttcgctcaacttcttttccctctcttgcaagttcataaagtttgcgtccgtttactttcaaagcagaatacatcggaggaatctgctcctgatctcctaagaaacttaaaattgtacgctccacctcttcgtctgtcacacttaccggatgttcttctaacactttaccagtcatatcctgtgtatctgttacaattcccaaccgaagaactgcctcataagtctttgttttatctgtcagcaattcacaaagctttgtcgcttttccaaggcagaccggaagcacgccttctgcttcagggtcaagtgttcctgtatgaccgatttttttctgtcttaaaattccacgaagctttgccactacatcatgagaagtataacccttttctttgtatacattaattactccgttaatcactgcattttttcctttatttctttttcaatctgttttagcagattattcataacatcgtaaatagacccctgcatcgtgcatccggctgcacgtacatgaccgcctcctgagaaataagatgctattttatttacatctacttttgatttggaacgaagacttactttaaattcctgtgtctttgtttcataaataaacacagccacttccactccacgggtcagacgaagctgttctacaatgccatctaactcttttgggcctactccgtaaaaatccaaatctctttttctaagacaaccaatgatgcattttttatctaacacctgaatgctttccatcaggcatcttcccagaatctgattctgcacatagcttttttcatagaaagactggtcaatgatactggaaaaatcaattcctttttccatcagctttgccacaacccgcatggtttccggtgaagtacaggaatatttaaacacaccggtatcgcttgcaattccggtataaattgcttctgccacatcttttgtgattttttcttcttctaaaaggtgaaacaacagttctgatgcagaactcatttcaggttcaatcagattttcatctgcaaacccgtgattactgatatgatgatccagacagatcgtcttctttgctgtttttaatgcttctcctgcaactccaattctgtccggtgaactgacatctaaaagaatcaacaggtcatattccgcctgtgaatcatattcctgttttgcttcttccagatttttgatataagaaaatccttcttttgctgtttccaaatagacatcacatttgatatccagttcattttcttttaaatacaggtataatcccatacaagaaccaatacaatcgccatccggacgtacatgtccggcaatggcaactgttttaatacctgctaatttactcgctaatttctccatcttcctgcacctccccagctgcatctttatgtgttacttcatcaattaattttgacatagaaactccatattcgattgattcatccaggataaatcggatttccggtgtatttcttaagtttacagtcttagcaagctgtcttctgatataaccctctgcacttcttaaacctgcaatcgtattcttttttgcttcttcatcacccagaacactaatataagctttacaggtttttaaatccggtgctacttccacagaagtaacagaggtcatcgggtgaatccgcgggtctttgatttccccacggataatctgtgcaagttccttatgaacttccgcatttacccttgtattcttaatactgttttttctcatttataaagctctcctatcttggtacttctaccataatataagcttccactttatcttcttcctgaatatcgttaaagtcctcaaatacaagaccacattcatatcctgcttttacttcttttacgtcatctttgaaacgttttaaggaagcaagatttccttcataaatctgttcttcgcctcttgtaatacgaactttacagtttctctggaagataccgtctaatacataaccacctgcgatagtaccgactccggaagctttgaatgtctgacgaacttctgcatgaccaattactttttcttcgtatacaggatcaagcatacctttcatagctgcttctacatcttcgattgcctgataaataactttatacagacgtacatctacgccctcctggtctgcaattgtttttgcagtcgcatccggacgtacattaaatccgataatgatggcatttgatgcacttgcaagagaaacatcagattctgtgattgcaccaactccaccgtggattacttttactacaacttcttcattagaaagtttaacaagactctgttttaccgcttctacagaaccctgtacatcggcttttacgataattggcaattcctttaagttaccggcctgaatctgggagaataaatcatccagagacatttttgcttttgtttcttcaagcagacgattcttgttttcagaaacaaaggtagcagcaaagcttttcgcttctttatcattttctgttgcaactaagatttcacctgcatttggaacatcgcttaaaccaagaatttcaaccggtgtagacggacctgcctcttttactctctttcctttatcatccatcatcgcacgtactttaccagagcatgcacctgctgcaatggagtcaccaacttttaaagtacctttctgtactaaaattgttgcaaccggaccttttcctttatccagttcggcttcaataacaagacctcttgctcttctctttggatttgcttttaattcttctacttctgctgttaacagaatcatctctaagagggtatcaattccttctcctgtgtgtgcggaaaccggaacaaagattgtgcttccaccccagtcttccggaattaattcatactcggataattcctgttttacacgttctacatttgcgcttggtttatcaatcttgttgattgcaacaatgatttctactccagcagcttttgcatggttaattgcttcaattgtctgaggcataacaccatcatctgctgcaacgacaagaattgcaatatctgttgcatttgcaccacgcatacgcattgcggtaaacgcttcatgtcccggtgtgtctaagaaagtaatcttctgtccgttgattgttacaacgtaagcaccaatatgctgtgtgataccacctgcttctcggtctgtaacatgagtatttctgatacagtcaagcaaagaagttttaccatggtcaacgtgtcccataacacagacaaccggcggtcttgaaactaagaggctttcatcttcctcttcttcttttaagagttcttcgatgacatcgattttttcttccggttctgcaataatatcataatcgagtgcgatttcctgtgctttttcaaaatcaatttcatggtttactgtaaccatgataccatccataaacagtttcttaacgataaccgatggctgcatcttcattttttcagccagttcacggattgtcattttttccggaagtgtaatttcctttacttcttccttcttttcttctactttcggctgagtacgtggtttctgaagtgcttttggaagtctctggtttggtcttcttcctccaccctgatttggacgttttccgcctttgttattattctgatattcatctttacgaacatcttttttcttattgtctctgtttgccttacggctgtctttttctacaaactctaacttcggaacttcaaatttgcttcctttgtcattatttctgaatccaccctgacgattgtcattgtttcttactccgccctggcgattgtcgttgtttctgaatccgccctgacgattgtcattgtttctaaatccgccaccctgacggttttcattatttcttggtccaccgccctgacgattgtcattgtttctgaatccaccttggcgattgtcgttgtttctaaatccgccctgacgattgtcattgtttctaaatccaccctggcggctctcattatttcttgagccaccctgacggttctcgttatttctgtatccaccctgacggttctcgttgtttcttactccgccttgacgattgtcattatttctgtatccgccctgacggttttctccacggttctctccgttattatagcggtttggacggtcccctgtatttccctgacggttatcattgtttctataatttctctgacggttatcgcctgtatttcttccctgatttcttgtctgtcctgactgttcatgtctgttttgtgtattatttgtattttccgttttcatgcctccctgtaccggattttctctctccggctgacggcttcctgcttttttctccggtttatgacttgcattttgcggacgaaaaacctgaatcagttttttctttggcttttcttctgattccggcattgcagcagctgtcacattcccctttctaaaatttgcccgtaccatttctgcatctttatcttccacggtactcatgtgacttttcacatctatatttttagatttcaaaaaatccattacgtctttattggtttttccaaattcttttgcgagttcatgtactctttgttttgacatatacctgcctccttcatttagctacctgcctgctctaacttttttgtcatggcctttgcaaaattttcatctgtcactgcgattaatgcccgatactcttttccaatggcccttcccaattcctcctttgttccgatatcataaagcggtacttcataaaacacacacatatcatgagcacttttctttgtattcttagaagcatcttctgctaccagtacaagatgtgcttttccctctttcacgtatttttccacggcgaactcaccgcttaccactttcccggctttcattgccagcccgagaagagacaattgtttatttagactcaagtttatcaaactcctttttgaggctttcgtatacatccggtgaaatcggcattttcaaagaacgctcaattcttttgtttttttctgccttttccagacattctttctgaaaacaaagataagcgcctcttccgtttttacgtccggtatcatctaataccactacgttttccggagtctttaatacgcgaagcatttcttttttatttttcatttcaccacaccctacacatttacgcataggaatcttttttactgtacccatgttcacctactcttcttcgctgtcaaaaacttcactatctgcttctgattcatattcatcagcggattctgcataatttttatcttccggatactcttcataagcttcttcgtaaagctcataatctccaagttcgcttgcctgtgattcactcttaatatcaatcttaaatcctgtcagccttgctgccagtcttgcattctgaccttcttttccgattgcaagtgataactgataatccggtacaattacctttgcagtttttgcatcaggatcagccaatacagaaataacctttgccggacttaaagcattttcgattaagagtgcaggattatcactccagttgatgatatcaattttctcaccacgaagttcttctacaattgcattgactcttgctccgttcattccgacacatgcacctaccgggtctacatccgggtcattgctccatactgcaattttggtacgagaaccagcttctcttgcaatactcttgatttctactgttccatcttttacttctgttacttctgcttcaaacagacgttttaccagctccggatgggttcttgaaaccataatctttggtccttttggtgtatcttttacttccacaatatagaccttgatacgttcagtcggctggaatacttctgtttttacctgttcattttcagaaagaatcgcatctgcttttccaaggttaatgctgtaattcttgccaaggcttctctgaacaataccggttacaacatctttttcttttccataatactgattgaaaattacttttctttcttcttcacggattttctgaagaatcacattttttgcattctgtgttgcaattcttccaaactcttttgatttaatttctacatttaccgtatcacctaaatcatactgagagttcattttctttgcatcttccaggctgatttccaataccgggtccaatacttcttctactactgttttctctgcaaatacaccaaactcacaagtctgcgggtcaatatttacttttatattatcagcttttccaaaatggtttttacatgcctgaattaaagactgttcaattgcttcaagcagggtatccttgctgatagatttttctttttcaagaacgttcagcgcctctagtaactcagtattcattttttatatcctcctaaatcttctctttttctttaaaaatcaaatgccagacgaatcagtgcaatatctgatttctgaaaagtctgttcgccatcttcattttcaatggtaacactgttttcatcataagattttaaaataccataaaactctttttcacggttgattgcacgatacgttctgatttccagttcttttcccatgctccgtttgtagtctttttctttctttaatggtctgccaagtcccggggaacttacctccataatataagcatcatcaatgaaatcctcttcatccagtttatcggaaaatgcacggcttacgacttcacagtcatccactgaaattccaccttctttatcaatataagctctgagataccagttacttccctcttttacatactctacatctaccagttcaaaattgtttgcttcaataatcggaagcagtaatgcctctgctttttgttcatagacttctttcttgctcatcttttcaccttctctcccattttccgttatacaacaagagtggaccttttcggtccactcttatgctatcgtagttatcaagttctttatcagcataacactattattcccaacttgcaagtcttttttaccaatacaccgtaatcaaaagctctgcatcactgcatccgacgttccacctgtagctgttttctccatcaaaagagtaaaactcctgaactgcctgttcaatcagatttccttctgcaagcgcactgactgcctgctgataagcttcttcatttgcaaacttaaaatcttctttttcccgtttttctaagatagaagcttttagtacctgataaatctgtgattcatcataagactcataccagctctgattctgtttataataattatagctgtcatctttacattccggaagcgtaagattgtcatccggtacatgacttctctccagcgtctgtgcagtacaacacagatatgtgtaagagaaatcctgaatactatcctcttccggcacaaatccggaactgctccaggtcgtatctacataataataattttctcctatccgcaccagattccatgcatgctccatgttttccggaataacttttccagttaccaaagtacaaaagattccatttcttacaagcagatactgtgtcgctttggcaaatcccatacaaaccgtactttgatttaaaaatacactctggatattctgattgttttcactctcactgtcataaagcacattcttcccaaggaactcataaacatacttaattttatcatattcgttttcacagtttgaaagttcctgtgaccattcctctgcttttgcttctatctgctgttttgtgtcttcaatctcatcttttcccatgttatagaccagattcaattccagcaaatccacatcggaattttctttttgattaaacgaataattctgctgttccagccagaaaatttccggatggtctacaaaaaccagattactgactttgttaatctcttcttccgaacaagcctcgacagtcacagaatcttcataattttcaattcccgcaagaatctgacggtatcttgttttttcttcttcatttaagttctgatacccataaagaaacggctcttcttccggtgtaatctctgcctccggaagtgtatcctgttctttttgtacatcactgcttgaggaaatcggtatcttgtcttgggtacatccacataagctaagtatcagaacaagtgtaaaaattccaaacctgtttcgttttttcatagatgattcctctcaattttttacactcttgtctttgttccttttccatctctctttgccagtttcagccgatttaatgaaacgctcttgcccttataatccgccgtataatctgtccggttttctaacaaatacgcatgctctacttcatcttttgcgcccaatgtaattcctcttactccaagtgctgcttttttctttaacggtacttctgttttcataaaacgtaagaaatatccctcttttgtctgaagtactacatattccatttcatctgccggttgaacgaaaacgactttatcaccctctgccagctttgttgctgttgttgtcctcttggaaacctcaaattcagaaccttctactaattttaccattccaaaagcagttgcaaaaagcatccgactctgcttaatctgatttaaactttccacataaaccagctgctctttcttgctgtcaaaattgctgacattatcaatcggaactcctttatctctcatttttccataaggtaaatctaacacttttatagtatgcagacatccggtatctgtaaatacacagattttatcggtattcatacaatggaaaatatggcggttttcctgatgaatggtttctttatttctttcataaaccgactgatctaccgtttttgcatagccaaaacgatccatcaaaaagacaacttctgcttcttctattttcttttcttcgtacaccgcttctttggcattttctatctgtgtttttcttggttttccataggctttttttactgcctttaattcttttataatcactgccgccatggaatgataatgatttaagatatcctcatactgtgcaattttctttaaagtctcttcgtgttctttcgtcagtgcttcaatttcaagcccgattaatttatacagacgcatgtctaaaattgcagttgcctgcttttcggtaaatccaagttttttcgcctgtttttcactggttttcgtgcggaaacggattccttctgttgctccgtttaccagacagtttttcacctgttcccgatttttactgcctcttaaaatttcaataatcaaatcaattacatcgcaggctttgattaatccttcctgaatttcctgtttttctttttctttggaaagcagggtgttatattttcgtgttgtcacttcaaactgaaaatccacatgatactcaataatctgctttaaacttaaagtctccggtttaccatttgcaactgcaagcatgttgaccccaaacgtatcttccagacgtgttttcttatatagcatattggtaagattttcaatatctgtaccttttttgagttccaatacaatacggattccctcttttgaggactggtttgagatatctacaatatctgtcgtctttttggattccacaagccctgctacatcatttaaaaattttccgatgtttgcaccaatcatcgtatatggaatctctgtgataacaagcaaatttcttcccgctttgcctttttcgatttccacttttccacgcagcttaatctttccggttcccttttcataaatcgaaagcagttcgtctttattgactacaattcctccagtcggaaaatccggtccctgaatatactgcatcagttcttcatttgtaatttcgttgtttttcatataggcaatgacgccatctaccacttcatttaaattgtgaggcggaatacttgtcgccataccaaccgcaattccgtctgctccgtttaaaagcagattcggaacacgcaccgggagcacttccggctctttttctgtctcatcaaaatttgaaacaaagtcaaccacgtctttatctaagtcatttaaatatacttcctgtgtaatcttctcaagacgcgcttccgtataacgcatggctgctgcgccatctccctcaattgaaccaaaatttccgtgaccatctaccaaagcctgtccctttttaaattcctgtgccatgacaacaagggcatcatagatggaactgtccccatgtggatggtatttacccatcgtatctccgacaatacgggcacatttacgatacggtctgtcataacggattcctaattcatacatatcataaagtgttcttctttgtacgggttttaatccatctctgacatccggaagcgctcttgatacaatgacactcatcgcataatcaatatatgatttctgcataatttccgaatattcagttctgataatattatctgcgtttgccattttctttccccctatacatcgagttctgcatcttgtgcatgttcatagataaatgcctttctcggcggcacttctgttcccatcaggatttctgtaatatcagatgccattcttgcatcttcaatttctactaattttaacaatctggtttccggattcaaggttgtctcccacagttgctgtgcatccatctctccaagacctttatatcgctgtaaggtaaaggcacctttatgtgtctttcgataacgctccaatgccttatcatcgtataaatactcttcttttcctcttgccggcatcgctttatataaaggcggcatggcaatatagacatgtccctcgtaaattaattccggcataaagcggtaaaataaggtcagaagcagcgtagaaatatgcgctccgtccacatcggcatccgccatgataataatcttgtcatatcttaacttcttaatatcaaaatcatttccatatccttcggaaaatccacagccaaatgcgttaatcatagtcttgatttccgcatttgccagcaccttatcaatgcttgctttttctacatttaaaatctttccgcgaatcggaagaatcgcctgaaaacttctgtcccttgcagtttttgcacttccacctgcggaatcaccctctacgatgaaaatctcacagatagatggatctctcttttcacagtttgcaagttttccattggaatcaaaagaatatttctgttttgtcaacagattcgtctttgctttttcttctgtttttctgatttttgcagatttttccgcacaggcaagaatgtttttcaaggtttcaagattacgatccatatataaaaccagttcttctccggttacttttccggttgcctttgaagcgtcctgattatccagttttgtcttcgtctgtccttcaaatcttggagccggatgcttaatagaaatgactgcagtcatcccatttcgaatatccgagccggtaaagtttgcatctttttcctttaaaattccaagttctcttgcataactattcattacagaagtaaaggttgtcttaaatccggtcaaatgtgttccgccttctgcattgtaaatattgttacaaaagcctaagacattttcacgaaattcattgatatactgaaatgctacttctaccgtaattccatccgattcacctttaaaataaaccggctcatgaatgacttcacatttcttattcatatctttaataaatccaacgattccatccggttcatgataagtaatttcttcgacttcttcacctcttttatcactaaaatgaatcgtaagattcgggtttaagtatgcagtctcatgcagacggctctttacttccgtcgctgaaaatttggttttttcaaagatttcaggatccggtaaaaaatttacctctgttccggtttcccttgtttttccaagagttggaagcagcccatcttccaactcaattgtcgggatacctctctcataatggtcatgatgcacatagccttctctgctgactttgatatccaaatacgtggataaggcgttaacaacagaagaaccaactccgtgcagacctccacttgtcttataagcggaattatcaaatttacctcctgcatgaagtgtcgtaaataccagtcgttctgctgaaattcctttttcatgcattccaacaggtatgcctcgaccattatctctaattgtagcagaaccatctttttcaagcgttacaaaaatattactacaatatccggcaagatgttcatccaccgcattatctacaatttcgtaaatcagatgatttaacccttttcttgaaacacttccaatatacatacccggacgcttacgcaccgcttctaatccttcaagaactgtaatactactggcatcgtaagtattcttttttgccatttctatttcatttcctttctttttctgtctttattttaatttttctcttcaacacctcttgatataccacgcctgcaagcagtccacagattactccaattccaatccctgctaacacatctgtcggaaaatgtacatataaatacaatcttgaaaatgcaatcaaaactgccagaataaatgcacagactcctgcttttttattcacatgaaagattgccgttgcagaagcaaacgatgcctgtgtatgaccagacgggaacgaataatcttttggcattgcaactaaaaggtgcaccgattcatttatccagcatggacgctctcttgcaaccaatggctttaacatcagatttgcaaaaagtgcagaaaaacataatgccgtcaaaatcaggattcctgtctttctgtatttttttgtaaagagtaataaaactcccaaagcaatccagaaccatcctgcatctcccaaaaatgtcacacctaccataagtttatctaaaacaggtgtatgtatgcattgtaatgcatcgagcaatgtaaattcccagctcatttttctcatttcctttctcttaaaaatgccgctgattctatgttcagatttttacgcgctatttttctatcatatcctatttcgtcttgtttttcaatttcaaaaattgtatggattaaaatacaatatttttcaaaaaaatgcttgcttttttattattttatgtgtattataagtgagtacggttcgttggtcaagcggttaagacgtcgccctctcacggcgaaaacaggggttcgattcccctacgaactgctgagttgaaagcatgaagaattagtcttcgtgctttttttatgctttcttttcccttttattgacagtcttattatcctactatacactatacttagtgtttattttatataaaaaagaagaaaggattttttattatgtctcaatcgaacacaaatgaaaacaaaatgggcgtacttccgattccaaagcttctgcttcagatgtctctgcctatgatgctctctatgcttgttcaggcactttataatgtagttgacagtatctttgttgcccgcattaatgaaaatgccctgaccgctgtttctctggtttttccggttcaaaatctgatgattgcaatcgcagtcggaaccggagtcggtgtcaatgctgtactgtcacgaagccttggcgaaaaagattttcatactgccaatgaatcagccaaaaatggaatctttctggcactcatcagcagtattatttttgcaattctaggaaatattgcggcaacctttttctttcacatccagaccgatgatgctcaaatccgccagtacggtatttcctatatgaccatcatctctacgatgtgtattgccgtttatatgcaggttatgatggaacgactcttacagtctaccggccgtactttttacactatgatttctcagggtacaggtgcaattattaacatcatcttagacccgattttaattttcggattatttggtatgccacgccttggcgtttccggtgctgccattgcaactgtctgtggacagatttgcggagcacttttagcctttgcctttaacatcaaagtaaatacagacatcaacctgaatatgaaaggcttccgcccaaacaaaaaaattatcggtacgatttattcggttggtgttccatccattgtcatgcaggcaatcggttcggttatgacatttggaatgaacaaaatcttaattcagtttacttccactgccactgcagtctttggtgtttactttaaactcaacagctttatttttatgccaattttcggtctcaataacggtatggttccaatcgttgcttataactacggagccaaaaacaaaaaacgaattacgcacacaattcgcttaagtattgtcagtgcaatctgcattatgcttttggggcttgcattatttatgatattcccggctcagcttttaggattatttaatgcttcaggctctatgcttcaaattggtgttccggcgctcagaattatctgcttaagtttcacctttgcaggattttgtatcgttgtcggttctgtctttcaggcacttggaaacggcatatacagtttaattatctctgccacacgacagcttttaattattcttccagttgccgcactgcttgcaaaacttggtggtctctccgctgtctggtgggcaattccgattgcagaaattgcatctgttcttttaagtacatttttcttccggaaaatttataaagaaaaaattgcaccacttgggaaagcttaatattttaaactaaaaaactgctgttaagttgaacgataacttgacagcagtttttttgattgaatttggctgggtgtcaagtagcagtcagttccaaaatcaatatgaaccataccacctacttcactttttcattagcttatcacaagtttctgcctgttcccttaatacacgaatcagcagctggtattcactgacatcatcaaaaataccattgcagaggtcttttattgcttttgcctcttccaggacttttcaatcctacttaaggtatcctcactgcggctgtggtagataaatagtagtatcatttgtaacaaaagacatcgtaagacctcccagataagttctggttatattttaacagataatggatgatatgggtatggtatcatgtgttaaattttcaaggtacaaatctaactgaataggtacgagcttttgacgcttaaatcattatatagtaatatatttaaaaagcttgaccttaaataacaaaatatggtatatttcaatcagaggttttgttgtatgcaaccaatgttagtctagtataactacgtaaattttttattataaaaatactagtgacaaaattaaatttgtcactcacatcttattattaaatataagcacaaatacaaatattagtagctgaaatattaaaaagattataaatgaggtcattatgaaaaaaaaacttgcagtcatcatcatttttatatttggaatatttatagtagtaggaaacttgtgtaaaccaacagatttcagtatagaaggtaaagttatagaaaaatatgagaaagcatttctgttagaaacagatacctccgataaaatactttgtaattgtccgaaaaattatgatatttcacaactagaaatcaatgataaaattacggtttatttcaatggtaaaatcttagagacttatcccgcacaaataaaaaaaacaaccaaaatcaaaaaataattaaaaattcttgcaaacaagagaggaggttgtatgaaacaaattcgattactttttcttggagtgatacttagtattatgacatctataagtgtatttgcaaatagcaatgtggtagaaaccgaaatcgaacaaaaaaattgtcaggatataagcaaaaatatggaaaccggagaaattcttttaaatgagatacctacaactttaaataatcccagtagtggaactacagattcttttataccaagtggaataaaagaagataagcctttaacaagagaaatcattggaaaagataacagatataaaataacagatactactacttttcctaactcagcaatttgctatgcagaaatgaaatttcctaattcagatagcatttacgttggaactgcttggatgtatggcaatcgtgttgcagtaacagcagggcattgtgtatatgactcatcattaggcggatgggctgaatgggttagaatataccctggaagcaatggaagtgaatctctatatggagtctattatgcatctgtgttacatactgatactaagtatgtaaagtcagaaaattccaactatgattgggggcttttagaattcacttcaaacataggctctcaaacaggatactttggtgcttcatggacaactgacagtttagtaggaacatgggttgtattaagaggatatccagcggaaaaatctgcttgtttatggacaatgagtggaaaaattgcaaccagtggtacttttaaattaggatattatatagatagtacaggcggacaaagtggctcaccaatatacaaagtaactaatggaaattatcaaagccttggcattcatacaaattattcacctacaaatgaatataatgaagcagaacgaattgataaatcattgtttgaaatcatgaatcaatatagataagatacaatatattaatggttgttgtttgcaagaattgattattcaaaaattctgaaatttgatgctacatgttaaattccagaatttttttgtataataaaaaaggtaaaacattagctgatgctaattaatatcactaatgttttacctttttatcataccaaaatccagaaaaaaataatttctgcacactacttcttactctgcttactctatttttattcttccggtgcttctgccggaacgaaaatccgtttatctgccgcagtttccggcagtttgatttttgctcttctggttgcttcttcacagaaaaagtcctgtgaatttagcagcattttgcctcgtttatctactttctcatacgtgccatccggctgaagaatatgtgcttttacattatcttccaattgaatctgtaagatatgtttcacttcttcttttaactgttcatcttctaccggaaatacaatttcgacacgtttgtctaagtttcttggcatccagtctgcacttcccataaagatttcttcatttccatcgctgtagaaataaaaaatccggctgtgttccaggaagtttccgacaatcgaacgcacggtaatgttttcgctgattcccggaattcccactttcagacagcagattcctcgtacaatcaagtcaatctttacacctgcggcacttgccgcatataacgctgcaataattcctctatcgcaaagagaattcattttcgccacaattctggcttttcgtccttctaatgcattttttctttcgatttcaattaaatgaagaaatctgtctcgcatccagagcggtgctaccactaatttattccaggttcttggttctgaatatccggaaagcatattaaagactgccgttgcatcctctccgattcttgctgaacaagtcaagataccacaatctgtatataattttgcagtcgaatcattatagtttccggttcccagatgcacatatctgcgaattccattttcttctcttcttactaccagtgtaatcttactgtgggtctttaatccaatgactccataaataacatgacagcctgctttttcaagcatttttgcccagacaatattattttcttcatcgaatcttgcctttaattccaccagtaccgtaacctgttttccattttctgccgcctgcgcaagcgctttgataatcggtgaatttccgctgacacggtacagggtctgtttaatcgccagtacattcgggtcttttgccgcctgctgtacaaaatctacaaccggatagaaggtcatataaggatgatgcagtaaaatatctccctgtcgaatctgggtaaagatatcctcatcattcatcattgccggtacctgtgccggaatgtatggttttgttttaaattcatcaaaacccggaagcccatacattttcatcaagaatgtcaaatccagcggaccattaatcttgaagatatcctcatctttaatctgaaattcctcttccaaaatctttaacagtctctcatccatccgctcttccacttccagacgaatgacctcaccccactgtctcttctttaactgtttctggatttcctttaataagtctgctgcctcatcttcatcaattgtaaggtctgcatttcgcataatccggtaagggcaggtacaaaccacagcattacttaaaaacagtttattgatatttcgctcaattacttcttccagtaaaatcacaaccgtatttccatctttatcatccggaagctgtacaattcttggaagtaccgatggcacctgaaccgttgcaaactccaactcttctttcccttttttatcttttttggaaattaatgcaccgatatttaacgttttatttcgaatcaatggaaatggtctcgcagaatccatcgccatcggagtcagtaccggatacacttcatcttcaaaaaaggtatcgacaaactcctgctgctctttggttaagttttcatgatgctctactacttttaaaccaatctttttcagtgccggcaaaagagaacgattgtaggtattgtactgtgtatctaccagttcctttgttacttttgaaagtgcttttaattgctcttttgcagtcattcccgcaatatccgttttggtatattttgcatgcaccatatcttttaaagaagcaacacgaatcataaaaaattcatctaggttcgatgccgtaatactcaaaaattttaatcgttcaaacaacggcagactcttatctctcgcctcactcaaaacacgctcattaaattttacccagctcaattcacggttagtataatattccggctttgtatattctttttcgttccattgcattttttccacctactttctctttttccgacgtaatacaggacgaatattgaacatttctttaaagaaatctgctttctgtgtcagcagcccctcctccaacaataagttttcctgtgtatcaatcacaagtaccagctctttatcctgaagctgtacttttacattctctgctttttgtttatggcttcgatccaatgcatttgccactcttaaaatcgcagtcagctttccaattaccatatacgtgtctcggtcaatggtactctttgaatccgcttcgccataatatttaaatggctcattgttaaaacgcactatatttgcaatcatctctcgctcagcgtgcgaaagcccgataatttcggtcgacataataatctcatacgaacattttgcgacctcactcatactgatatattttccacaatcatgcaaaatgactgcaatctgtaaaagcaggcgctctcttggtcccatcccatgcactcttctcatactgtcaaaaattgtctctgcaacctttaacacagcacgcacatggctcttactgctcatataacgctttgcaatattttgtgcacaagctaaaatatcgttttcaaaattatgggtactacgaatcaaacgtctgccctgtgcataatcataagcaattccgtcatttagctgtgttcccggaacccacagattctgtgcccccatctcatctgcaaaaacacgataaatgatcaaagccggaaccaggatacttgcatattccagtgtaattccaagttctaccgataactgctctgcggatttatgcacgattcgctcatacatctccataaaaactgctttactaacggtacgactctctcccattccataatcgctcaccagcaatttttctataaagaaatcgcccaataaaataatattatctacttttcgctcttttaaatgaagtttcttaaaacttaaaatgtcattatgaattaactcttctactaatttttcataataaatagtttctttttcgacagagagcagacgctcacggatacgaagacttcccatcttaaaattctgagttgtcacaagcgtatctttatcaaataatgaaatctgtacatttccaccgccgatttctatgattgcagtccctttctgaatgatttttgaaaaatctgcttccttagctgcaatcgatttatatccaaaaaatctctgctcagagttacttaaaatttcaactcggattccggttctttgataaacctgctccagtacgatccagacatttcttgcttcctgaagggtacttgtcgcacatgcacggtaagaagtcactttatactctttcataattctggaaaaatctccgagtacttcgcctaatcgctgtgcagactcataactaatttttccattggtataagtgtcatgtcccagctcgattctgctacgcacttcatctatcttttcaattccaatttttggagaaatctgatagatatccatactgacttcgtaagaaccgacatcaattgccgcaaatattgttactgccatttttccaccgccttacattagtttgctgtttaattatatcgttgtaagttgttgttttcttctaatctctgttaaattcaggtaaattttcttgaaaattcgtcttttttgtcttttagttctcaagatattcttttagtgcttcataataattctgtgcagtttcatatccatcttcatatagtttgtgcagcttatccgtatctctttcaagtcgtccgatttcaaccggtttttgtggctgtaaaataaatatttttccctctttttcctgacggtataaataatccagtgtctgattatacccaatgtggcggttttccaaagcttctatcagttttggaaacttctttccataacggactttcattgcaggaatcaacttatttttttctttcctgtaagttctgtcacgagtcagtaccactacatttttctcatttcccattctctgagcttccataatcggaatggaatctgtaattccaccatccagatacggctttttatgaatccagaccgttcttgacataagaggaagcgaacttgacgcacgaacataacaagtgtcttttttcatatctttgatttctttgtactccgcattcccactttcacaattggtaacaaccgcataaaatttggttttttgtctgttatatgtatcgtaatcataaggattcaatttttctggaattttacggtatatcatatccgtgccaaaataatctccggtctttatcaggctttttattccacaatattccgggtcatccatataatcagtaaatgtatggtaccctctgcctttttgtttagaaagataactgcatgccatacatgctcccgctgaaacaccaaagcaagtatcaaattccagacctttttcaataaagaaatcaagaattcccgcagtgaatacaccacgcataccgccaccttctaaaattaatcctgtttttgtttttttactcatgctgtcatcacctttttttattatttatttaaaatcattttacgctttttgtaagatttgtacaaggtaaattcttgtaaaaaaaagaaaccggccggggccggtttctgatgggtgaatattagaggtttggttttgtagatgcttttacatgtctgttatagcgttaagaggtaagagtagaacttacatttcatctcaatcctctcaattccgctttctgttcttccgtaattcgattgctttccatcgctttttgaattgtcttcctatgcacccattccggcaacttccggtcttttagatatccaatcacagcctcccattgctttgcaagcgcagtcgcaaaataccaagcaatcatcatattgacataatattcgtccgaaatcacagctgagacaagtttcggatattcatctttaaaatcttcatctaaatacagccgtaatagcactccaattccataccgaatggtatacgtatcatttgaagcaatccaattttttacatccacaatcaattccgctttgtgtttttcaaaacattttggtaagggtaaatcacaggttgcccaattatcaatatagggtaaaaattgtgtcacttcttttaaacattttttgtagtcgcaaatctgtgtcacaagcatcaaatgtaaattattttcctcgtaatactgatgaggaagttcttgtaaaaagttttgtgcttcttttgtttgggcaaactctttcgcaaatttacgaagaatcggtgtacgaactccaatgattttttctttttctgtcttcggtaacaacttgctttgaaaatcacgatattttaaatcttgtagttcaaataaacttctttgtagttctgtcatatgttgtttttttacctcgtctctgctttctgaataataaaggttgcagatgtgttttgattagatgttgtatttctatttcgttcctttttttacagatgcatttctattattttattaatgcaaatgtatctttagtttaggtattcttaagttctgaggtacttttggcgaactcgaataaaaagaactgatggaataacaaaaaatgagtttcaatccctcataggtaatatacaacaacagtatttccgccatttctaattctcattatcctctaatcacccattttttgcaagttttttcacaaaaagtcagtcaatctctttttagaaatcactcattttccttgattttacaacatttcttagaaatcgccaaattcaccttgagactgaccgactttttaattccttccttttattttgcttaagctaactttctttccttaacaataatgaatcccatcccagtaaacacattcttttactatcgtctccggcagaaattctaccccttttaaagcatactccttaaatttttcaaatccaactctatcaataatatatccaatatgctcttttctcgcaggtgcatccggagagatatactcttcaacaaatttatacgtattcttaataatcctaataatgttttcttcatctgcccacacaagaaaatcctgtccaagtcttggatttttctttccggttcttcccataatggataatttgtaatattttttcttacttcttgtccatgctctggtcggacattttgtgacacagaccccacagccgatacatttttgagtatctctttcaattcgataattttccatacgaagtgcgcccactgacaaactgttacagccttttatgcacgcctggcagctgacacagcgggctgcatcgtactgtggcattgtcattccgataattccaaaatcatgcattcttgcttttgcacaatcattggaacagcctgtacatgcaattttaaaatgcaggtcgtttggaaagatttctttatcaatttttcttgctagttctgctgtattataattagcaaatggacagacattattcccaatacatgcctgaatatttctggtcccagatgcttcgtatcctttttcacgattcgtttcagcttgatttgtttctaccagctcaataatcggctgaagtttctgatttactacttccatatcttcaagatggattccttctatctcaaatccctgtcttgttgttaaatgtacatatccatttccatattcctttgcaatctcctgtaccattccaagcacatcggcatttaaatatccgcctggcacacggattctggatgcgccgattcctcgttcttttgtaattctccaggcattctttttcgctttttttgtattgatatccaaactcatttcgcttctcctaatctatcaattccctggcttctgtataattaaataccggtccatccagacagacatatttttcattcattctgcaatgaccgcattttccgattccacaacacatttttctctcataagaagtccagatctgctcatctttaattccaagtttcttaatttccataatcgtaaatttaatcatgaccggcggtcctacgcagataaataccgcattttcaggatttttaaatctcaaatccggaatatatttggttaccattccaaccggaccttcgtatccttccgatgctgcatctacggtctgaattacatgaaatgtttttttccattcttcaaaatctttcttaaacagcacatcttccggacttttaaatccagcaattagtgttgtactgactgcctcctctggatgagctgaaaaatactgaatcaccccacgcattggagaaactccggttccgcctccaataattacgagttccttccccttataattttccagttcaaacccattgccataaggtcctctgataaacaatttatctcccacataattttcaaatacctcgtttgtcacagttcctactcttcggatggtaaaatcgaccagaccatctccaattccactaacagaaatcggagcttctccatacttcggaatggaaagttcaaaaaactgtcccggttttacttctccatcatactccattcgaaaagtatattccaaatccgtatgttttatcacttcttttattttggaaagcttaggaatgtattcattcttcatttcttttttcctccttgctcaaccggttaatcagatttgaataggaaatatactctgggcagacactgtcacatcggccacagcctacgcacatcggatatccaaaccgcttctcataatgataaattttatgtaaaactttaaaacgtaccttatctgctttttttgtacggaactcatgcccgcccgcaatcgtatcgtatttatctacctgacaggatgcccacactcttcggcgttctcctgccttttcattatctttataaaaaatatcctgcattgtaaaacaagtacatgtcggacagacaaaattacaacgtccgcatccgatgcaacgtgctccatactcttcccagattggaagcttggcactttcttttgataaatgttttggaagttctaccttttctaaatttgcttgtacaaattccggtaacacctctgcttccggcatacctttgaaatatttctttaactcttcatctgaaacatcaagacagacacggttgtttttcaattttaaataggcatcatagttctcgcttttgttggttcccatgctgacacaaaaccctgtttcacaactttccttacatcccatcaagataaattttgcttttttacgcattctcgcataatagaaatcttcttttccactctttaaatacatttcatccaatcgttttaatgcgtgcatttcacaggaacgaagaaaaatgagcaaatctttttcctgctctttcggtacgattgtctcatcttctgtaaaataaaaaatcgtctctctgattttaagcagcgattccttaaaagaataatctgaacgcttttcccattcaatttcatccaaatcttttatcttatcatatcgaatcacatcgatttctgagaaggttccctctccttcttttcgtaccggagcccagatatcatatttcttttttatggactcaaatatttctgaaaatgcttctctagctaactgatatcccataatcgttcctttcttcttactatttctatttttttatacaaaaaaatctttgttaatatcattttatcaacaaagattttttctttccgtgataatcatcacgttttattattctttttcatgaatttttttcaacaacttatcaatatctggaacgagaatcagcttttcttgatattcaattaagtttgattttttcaaatgtcccatcactcttgagacggattctctttttgcccctagcatgtctgccagaaatgtaatcgttactttaaatggaatctgtattcccgatggagtctctatcccatagtctcgagccaatttccagacctttgctataatctgcttttcaagcctaaatgaatttgaagtgttcgccagctgatgatacattttacgaattttctttgtgcttgaatagaccacttctcttgaaaatgctgcatcttccatatagtccataaaatattttcttggaatctttaacataagggtatcgcaaagtggctctgcactgattgacgcgattggtttttctacaattacttcatttaaaagtgcaccatctgtataaataaagatatttttccggtctccacggtgattatgacggtacagcaccacatagccttccacaatgaagtataatgtatctactcgttctcgctcccgaaaaataggaacacctttttcctgaagcactatttgtccgttcttttgcactgattcttttattgtttcactcgcattgttaagtatcgtacacttttggattgcttcactgatttccatttttctaccttacccctgataccctgcaagaaactgtgcaatcaactcaatgcacccttccacatctttttcatctgccacttccgccggcatatgcatatagcgcagcggaatcgacactaacaccatcggaacaccctgattagaaaaatgaatttgatctccatcggtgtaggaaagtctgcttgccgcttctctttgcacagaaatgcctgctttctttgcacactcttccatcttttcattgagtgcttttaccacaatcggactgttacaaagcaccggtccttctccaaggcataccgttcccatctctgccggatccattccactgcaatcacttgtatatgtaacatctactacaattgccatggtcggctgaattctggcactggtccaatatgctccggtcttggttgtctcttctcctgtcgtggaagctgcataaattccaactttacatcccaactcttttgatcgtttctttttcaaaggagaatattatgcagaaaaaagtaactttgttaacactcatcatcgagttaggcaaactactcttaagtattggattgctcgtaagcactgtagttggattatatctaatgttttttaagttttagaaaaaatacaacaaaaaagtccttgcttccaaggacttttttcactgccgctggccggactcgaaccggcacggtgttacccgcttgattttgagtcaagtgcgtctgccaattccgccacagcggcaagctgatttgtttggctgaatcgtatattataatatcatgctttgctacacaatgcaagcttttttttaatttttacgggcagattttttattttctctgcccgccttgtcttttttactgctgaatcagcttatcatagatatcaaaacagtcaaatgttgcaaaatagtcttttggctcttctgctctgcggattaactgtgtgcttccatcttcttttaataagacttctgctgatttcaattttccgttgtaattatatcccattgcaaatccgtgtgcaccggtatcatgaattaccagtaagtctcccatatcaattttcggaagcatacggtctactgcaaatttatcattgttttcgcaaagagaacctgttacatcatatttgtggtcgcaaggttccttttcttttcccattactgtgatatgatggtaagcaccatacatagccggacgcattaagtttactgcgcacgcatctacaccgatatattctttatgagtatgtttttcatgaattgcttttgttacaagacaaccatacggtcccatcatgaaacgtcccatttcagaatagatttctacatcacccattccagccggaacaagtacttcttcataaactttacggacaccttctccaatgacacggatatcatttggtttctggtctggtgtataagggataccaacaccaccggataaattgataaatttaatatttgctcctgtttcttcttttaattttacagcaagttcaaacagacgttttgcaagttccggataatattcatttgttacagtgttacttgcaaggaaagcatgaataccaaattcttctgcacctttttcttttaaaatacgaaacgcatcaaaaatctgctcggttgtcattccatattttgcatctcctggattatccatgattccatttccaagttcaaatgttccgcctggattataacggcagctgattctctttggaattgttccgatagtatcttccaagaaatcaatatgagtaatatcatctaagttaatggttgcacctaatttataagcataagcatattcttctgccggtgtatcatttgatgaaaacataatatcttttcctgtgcatccgattgcagaagacatcataagttctgtataagaagaacagtcacagccacagccatactcttttaagatattaatcaaaaatggatttgggcaggcttttactgcaaaatattctttaaatcctttattccaggaaaacgcttcttttactgctttgatattttcacggattcctttttcatcatacagatgaaatggtgtcggatactgttttacaatttcatccaactgttctttagtaacaaatgtttttttctccattttgttctattctcctcaatttttctctctaatcacatatacacggttattatatgtcacatgctttcatttttcaacaaaaattttgcagattaaagtgataaacaaaatcattactgatttacgatcacccaggaaaatgcttttgcagttcttttctctgcatctttaaaatgatttccttgattccattccaaaatacacttcactttattttctttcataattttctccacttctctaatattatctccaactgttgacagcatcgcatttttggttttgtcttctttgtctccaagactcaaatagatacatggactttttacttcattttctttcagataagtaaggaatcctggaaaccatactgacggtgatgcagccgctatccctgcaaatttatcactctgacagcacgcccaaagactaaatagtcctgctaaagaatatccacccagataatattttttatttttatctgagcataattgcggtatctctgtaagcaaatttgatgctccatcaccaaatgcttcttttccaaatactgccggtgctttccatggtgataattcttgattccagttatctacctttattgcaagcatttgtatctctttttttgtatttatttttattcgttcaacttgatttggtatttcattcagattatgagttccaacaggttggattagtacaatatttgattctggatttccatatttatatagcttcattcaaacaatttctcctcacatctttcattcaaattcctgctttttatcattagaattctataactatacgccaccacttttcatttgctgaccgattttcactctaaaatttccactcctgctaccaccccattacatgatatctttcttttgatgcagtatacattactattcctcctatactctcaaattctttcgggttgtttttatactacttatgttgtaattctttttacaaacatcaattcatgcctttattatacattaaaattttctctactcatactacaaatatttatgctacaaaaggagctgtccatccggacagcccctcctatctgtttctatctctattctaatcgattcttattttacctcaattacatgaagcatattggtaacattctgttcatttacagaactgtttgttgccgggtcaccggcagttaagactactaactgaccttttttcaccagacgtttgcgttttactgtttccattgagttaagcaaaatattttctgttgagtcttttgtataaccttttaatggttttacaccccagtaaagctgcatcttatgctgtacagattcgtttggtgtaatcgcataaatcggcattggaggtctgaaactggataccagacgtgccgtcttacctgacattgtcggtgtaataatgcaggctgcctccagatttcttgctgtacgcacagaagagattccaattgcacttgaaatttttgtcttccgatacatacttctgtgtgtaacatatttatcataatctacatactgttcggtgctttctgcaacttctgccatcatctttaaggcttctaccggatattttcctgctgcggtttctccggaaagcataacagcgtctgttccgtcataaattgcatttgctacatcgccaacttctgcacgggttggacgtggattacgaatcatggaatccagcatctgagtcgcagtaataaccggtacatatttttcattacatttctgaatgattgttttctgaatatgtggaacttcctgtggcggaatttctacaccaaggtcgcctcgtgctaccataattccatcagccgctttgatgatttcatcaatattatcaacaccttcacggttctcaatttttgcaatgattgcaatatgctctgcatgatgttcagttaaaatcttacgaatttcattgacacctgctgcatttctgataaaagaagcggcaataaaatcaatatcctgagaaattccaaagataatatcatttttatctttttctgtaattgccggaagtttaatttttacattcggcacattgattccttttttctctccaagttctccgccattttcaatcagacagacaatcgaatctttctttgttgcctgtacttcgagttcaatcagaccatcatcaatcagaatcttgtcacctttttttacatctttcgcaagaccaggataggtaatagaacatcctttttcatttcccacgcactcttctatataaagagtaaaggtttctccctcttttaatgtaactttctgtccgccttctaaaactccggttctgatttccggacctttcgtatcaagaagaattgcaaccggtcggtctaattcctctcttacgtttttcagcagattcatacgatttttctgttcctcatagtcaccatgcgaaaagttaaatcttgccacatccattccattttttacgagtgcacgcattatcgtttttttatcggtatttggtcccatcgtacatacaatctttgtcctgcgcataatatcatatcctcctgattatttgatatgtgtatgtgtaaataaatgttcctgacaatattcatagtttccattgcatttggaacagaaacgaaattccaaatcgtccccgtcattttctgttctgccacaaattgcacatttatgttttgttatatttggtgtcatctttggatgaaccgccttcttaaactgctgttttctgtgtatttcacgtggcgaaatcgttttataatttcttgtcataaagaagaaaataataaaattcagtaacgacacaagaatcatcatacggacagcccatgcaccatatccggatacacgaataaagttataagccagatatgcaatatcaagatatgccatccatttaatcttaatcggtattacaaaatataacagtacctgcatatccggataatttgccgcaaatgcaaggaatattgacaagttaatataatatgtcgaaattatgcttgctccataaagggaaatctgaagtccgccaatgaaatacagcaagaaagctccaatcacagtgaataaaattccactgaaaatgtacacgttataacggaactctccccatgttctttcaagcgctgttcccagtgaataataaaagatcagcataataattgtaaaaatatccagtcctgaaggcggaattaacacccagctcaccagtctccaaatttgtccatgcagtatatggtacggactcaaagccagatagcccataatacctactccggtcatgttttgaaaaacctccagggcatatccaatcacataacacaaaataatatatttcgtcaattccggtattgcatacctgccgaatttccgttccattttatttaaaaaattcatttcatttcctcatttccggtttattcccgccctcaagaaattttctgatttcactttaaattaaaggaatgaaccctaaaacaggtctttctttgaaaaaataattgccacaatcagacttagtatcaaagacaacacaattacaatagcaaatccatacggactgtctgcaaatggcatcccgaatgattttacattcattccataggcactgaaaatcatagtcggaatggacattacaattgtaactgttgccaaaaatttcatgacaatatttaagttgtttgaaataacagacgcaaacgcatcggtcattccacttaaaattccactgtaaatatttgccatctcaatcgcctgcttgttctcgacaataacatcctcaagcaggtctgtatcgtcgggatattttttaatccggtctacctttaaaagcttttccagcaccacttcgttagaacgaagggaagtaataaagtagaccagtgatttttccagttcaagaagttctatcagctcctgatttctggtcgaagcatgcagtttctcttccacttcttcacttttcttatctatgatacgcagataatgcaggaacatgcttgcattattatacagaatctgtaaaataaaccgcgttttcatataagtataaaaattgcgtacacgcccgtccatgaattttccaagaaccgatgtatcttccagacaaactgtaaaaatcatttcatttgtgattataatagaaagaggaatggttccaaaccagtccttgtctcctctttcctctataatcggagtatccaccaaaatcaaggtataattttcttcaacttctatacgggagcgttcttcttcatccagaggtgcacgtaaatcatctacttctatctgaaaccgattacagatttcaaaaatttccgtagcagtcggatttgtcagggcaacccagcaaccttcacatgcttcctccatctgatgcatttttccatcaatggttttaaaaattcgaatcatggtatctcccttcgtctgccatgaatattattctgcgtaatcacatttatggaaaataatactgtttggagtttctaccttaagcggttttcctttcataatcaacagctttttctcataatcaattgaaaatgttgtgatagagtttgattcatgattgacaacagccagatgacgaccgtccgggaatacatcaaggtcttttggatattctccactgattggcagtacgaactgtctttcaatatgacctgtctcttcatctactttatacattgcaaccgtattttctccggctgtagaagtaaacagatattttccatcttcagaaagacacattccagaagttgcatcatgtgcctcatcttcatgggaagccaaagtgctttctgtctgaagcagttcaaatttcggatttttaccgcttccatcataactgtaaacctgaatttcattttttaattcatagtttacaaaggcaaactttccattcgggctgaatttaatcagtctcggaccagattctctgacacaacgaagaacgtcaaccaaatccagcttactggttctctctgtcggacgataaatcttaatctgatcaattccattatcaactgcacacagatattttccatccggagtcggacgcacacaactgacatgaggacggaagtttctttctgcaacactgccaagacctttatggaagacaccatccataacacttccaagtcgtccgtctctatgtgtgtgtactacggtaacttttccatcatggtagcctgcaacatacagatattttccttttgtatcggtggaaaggtgacagcctctcattccatcaataccaactttattaataaaggttaaatccccatccggctcgattgcaaatactgccacaccttcatcagcgatagagtacagatattttccgtttacagagatagccagatgggaagaattatttacaggaactacttttctctctgtcatagttccctcttccacatttacgtcatataaatgaattccaatactgcttccgtgagtataagttccaacataagcaacatacttttctttcattatagtaataccctcctgtctgttttttattcgttccgttgtccggtctaccgacattctaccacaaagtttttttttatacaatgcaatttcccccgattttacaaacatttatctcgcccttctattgacaggattttcggttctagtataatgaaatttaaaagcctggtaggaatcattccgtttctgccggcattttatttactatactttatttaaggagactgccatgaaaaaaacactggtggattttatccatatctcaaaaggatttggggaacagcttgttttagatgatttaaatctgtcggttcatgaaaatgaatttctcactctgcttggtccaagtggatgcggaaaaacaaccactcttcgtatcttaggaggatttgaatccccggacaagggacaggtcatttttgacggtcaggacattacgcatcttcccccaaataagcggaatttgaacaccgtattccagaaatacgctcttttttctcacatgagtgtatccgaaaatattgcttttggcttaaaaatttccggaaaatctgatgcctatattaaagataaaatccgatatgccctgaaacttgtaaatctggaaggatatgaaaacagacttccggattcattaagcggcggtcagcagcagagaattgcaattgcccgcgcaatcgtaaatgaaccacgtttactgctcttagatgaaccacttggtgctcttgacttaaaacttcgtcaggacatgcagtatgaactgattcgtttaaaaaatgaacttggtattaccttcatctacgtcactcacgatcaggaagaagccctcaccatgtccgatacgattgttgttatgaatcaaggttatattcaacagatgggttctccggaagatatctacaatgagccacaaaatgcttttgtagcagactttatcggagaaagtaatatcatcgaaggagttatgatacaagaccgcctggtacagattcttggtgcaaaatttgattgtgtcgataccggatttggacagaataaaccggtcgatgtagtcatccgtccagaggatgttgaccttgtagaaccggaaaaaggcacaattaccggtgtagtcacacatttaatttttaaaggtgtccactacgagatggaagtgcaggcaaatggatttgaatggcttgttcacagcacagatatgtttccggtcggacaaaaagtcggcattcatgtagacccgttcgatatccagattatgaataaaccggaatcggaagatgaggaggcgataggagttaatgaataagaaaaaattgcttgccggaccttatcttttctgggctctggcatttattctcatcccgcttgctatgattgtctactatggtcttactgatgcaaatggtcatctgacctttgaaaatcttctggctatcggaacggttgagaattttaaggcactctgtctttccctcctgctttctctcatcagcaccgccatctgtctgctccttgcctatcctctggcaatcattctttccaatatgaaagttggtcaaaatggatttattgtgctcatttttattatccctatgtggatgaattttcttctgcgcacactggcatggcagaccctgttggagaaaaacggagtcatcaatcaggtgttacactttttccatctgcccacactccagctaatcaatacgccttatgcgattgttctgggcatggtttacaactttttaccgtttatggttcttccgctttacaacgttctctccaaaattgacaaagatgtcatttctgccgcaagagacttaggggcaacagagctttatacgttccgtaaaattatctttcctttaagtattcccggtgttgtaagcggtattattatggtttttgttcctgcacttaccacctttgttatttctgatttacttggtggaagcaaaattttgttaatcggaaacgtcatcgaacaaaaattcaaacaaggaagcaactggaatgtcggaagtggtctttctctggtgctgatggtctttattttgatcagtatggtgattacaaccaaatatgataaaaatggagaaggaggcatgttctaatgaaaaaaacagcacgtaatatctaccttggattcattttatttttaatgtatgccccgattgcgactttggttgtactctcttttaactcatccaaatcccgttcaaaatggggtggatttacgctcaaatggtattcttccctgtttcaggacgacgccattatgagtgccctttataatacccttgcaattgcgtttctttctgccttaattgcaaccattatcggcacttgtgcctctcttggcatcaccgcaatgaaagcaaaatggcgcaccgttatcatgggaattaccaatattccggttttaaattccgatatcgtaaccggaatttccttaatgctgctttttattgcgtttcgttttactttaggcttttctacaatcctgattgcacacattacttttaatattccttatgcaatcttaagcgtcatgcccaaactaaaacagaccaataaaagcacttacgaagctgcccgcgacttaggtgcgggaccatttcagtcatttatgaaagtcgtatttccagatatcctcccgggtgtattgtccggatttttaatgacttttaccatgtcactcgatgattttatcatcacccactttacaaaaggtcccggagttgatacactttctacaaagatttattctgaagtacgaaaaggaatccgtccggaaatgtatgcactttccactcttttattcttatcggttatggtaattatgattttaatgaacacctcaccaaaagaaacagattctaaaaaggctggttcaacctcaaaagattttaaacgaaagcgaaaaattccatggcatcaggtaatccctgccggatttatcttattaatcgcagtaaccggattagttcatcatgtaagaacaaccggaagtgtctccgaagaacaggtaattgtttacaactggggagaatacatcgaccctgatgtgcttgacatctttgaagaagaaaccggaattcaggttatctatgaagaatacgaaaccaatgaaatcatgtatcctaaaattctttccggtgctattgcttatgatgtagtatgtccttcggattatatgattcaacgtatgcgtgaaaatggactgttaagcaaattaaaccttgataacattccaaatctgaaaaatattgaccctgcctatttaacccagagccaaagttttgaccctgataatgaatattccgttccatattgcgttggaacaatcggtattctctacaataaaaatatggtagatgagccagttgacagctggaatattttatgggatgaaaaatacaaggatcgcatcttaatgcaggattctgtacgtgatgcgtttgctgttgccttaaaacgtaaaggctattccttaaactcagtcgaagttgatgaactcattcaggcaaaagatgatttaattgcccagaaaccacttgtacaagcttatgtagtagaccaggttcgcgacaaaatgattggaaatgaagccgctctcggggttatttattccggtgaagcgctttatacacaaagagaaaacccagcacttgagtatgtcattccaaaagagggttccaatatatggattgactcctgggtgattccgtccaacgccaaaaataaagaaaatgctgaaaaatttattaatttcttatgccgacctgatatagctcttatgaactttgagtatatcacttatgcaactcctaatgcggctgcaagggctttaatcgaagatgaaagtatccgaaacagtgaaactctgttcccatccgataaagatttggcacgctgtgaaacattccgttttcttggagacgaggcagattcttattacaacgaactttggaataaagtaaaatcaaattaggagtgataccttgaaccgaacctttacttatcttattactcaaaaggattccccttgcacagtggaatcctatttaaaaaaacgaggttattctcatccgattttggttcagttaaaaaagacccaaaacggaattttagtcaatcaaaaatgggcttatgtcaaaacaattctaaatcccgatgataaacttgaaattcatctggaagagaccgcttcttctgaacatattgttccggttgagcttcccttctctattgtttatgaagatgaagatatccttgttgtaaataagccggcagatatgccgattcatccctcaattaataattatgaaaatactctggcaaatgcagttgcctactattataaaaaacagggagaaacttttattttccgctgtatcaaccgcttagaccgtgatacaaccggacttttaatcattgcaaagcacgctttaagtgcctcgattctttcaaaacagatgaaggcacgtgaaatccgccggacttatcttgcagtctgcaaaggtcagcttccggccgaagtcggcattatcaatgccccaattgccagaaaagcagattctgcgattgaacgctgtgttgatttttctaatggagaaagcgcagtaacccattatcgggtgcggtattaccagaatggctattcccttgtggaacttcatttagagactggacgcacccatcaaatccggattcatatgcagtatcttggaaatccacttccgggggattatctttactgtccggattactctaaaatctcacgcactgccttacattcctaccggcttgcattttgtcatccgattaccggaaagcgaatggatttttacgcaccgcttcccacggatatggcagcattttttcagtaaataaaaaagtactgcgtatttctttcaaatcacgaaatacacggtacttttttattgctctttattattttttctggctgctcatacagataagcctatgggggttctccaccaatttataatgcccgaattctcggcacttcatctacatgcagatattttccaattgtttttacaataatatcatggttgataaatggattctgatctgtcacgacaattgctccaatgactcccacttcctctacacgaatcggaaatcctccacccatgcaggaaaactctttttcatcaagtccaatatcttctaaggtttcttcattttgctttaattcgctgtataaaagcagactgcttttttccattatttttacggtattgaaggtccggtctgtaaaacggtcactgtttaatgtagtcgtatttccggcatacttaaataccgtgctgccattattctttcgaattgtaatcgaacaatccaatccacgttttttactctctgccaccagcataattcctaactgccatgcatcctcatttgtaaaatgattgaactgtaaaatctcttcctgcagacttaaaacattaattacttcatccattgtcatacgccattcctcctgtctgactttatgtgaaatactttttatatttaacggattctgtctggaaaacctacttttcgctgtactttgcggagtgttttatttgcataataactggctttttctccattttctttgataatagaatctaagtaagctttatctttttccagtctggcaacttcatcctgaagtggttttaacacacttactacagcttcaccgactgccattttcagttctccataacctcttccttcaaattctttcaccgcttcatccggtgtttttccgacacatgcgcagtagatatcaatcaggtttttcagtcccggctgctcctctctataagcaatatttgcctcggagtctgtcactgcacgtttacatttacggataattgtatccggatcatccatcagataaatacttccatttggattttcatcggatttagacatctttttagacggatcctgaagactcatgatttttgctccaacttttccaacataagcttccggaatagtaaatacatccccataaatattattaaaacgagtagcaatatctctggttaattccaaatgctgcatctggtcaattcctaccggaacaacatctgcctgatataacaaaatatcagcagccatcaagaccggataggtaaataaacctgcattgatgttatctgcatgttttgctgatttatctttaaactgcgtcatacgattgagctcgcccatataggtaaaacagttcaaaatccatgccagttctgcatgcccggatacatgggactgataatagatacaattctttttcgggtctaaccctgctgcaatgtaaagagtcagaagtgctcttgctctttttctaagtgtagctgggtcctgacgcaccgtaatagagtgcatatctacaacactgtagaaacattcatactcgtcacttaactttacccagttttttaatgccccaagataatttccaagagtcagatttccagttgcctgcataccactaaacaacacttttttatcattaatcatctttttgtcctccaagttttgctaaaataaattgtaacattgtgccactgtaaagtcaaatatacttgcacgaaaatttaattcgatttataataaattttgaaaaaacaaaccctgaaaggagaattagctacatggaaaaaattgcaagctttaccattgaccatataaaattacagcctggagtttatgtttccagaaaagatcacattggagacgaagtaattaccacttttgatttaagaatgacttccccaaacgaagaacctgttatgaatactgctgagatgcacacaattgaacatctcgctgctacttttcttcgcaaccataaagagtatggcacaaaaaccgtttactttggacctatgggatgccgtaccggattttatctgcttttagcaggtgactacgaatcccgcgatattgttgatttaatggtggaaatgtttactttcatccgtgactttaagggcgaagtgcctggggcttccgcaaaagactgtggaaactatcttgatatgaatctcggtatggcaaactatcttgctaaaaaatatctggatgaagtcttaatcgatatcaaaccggaacgtctggtttatccagaataattccaagttcaaatcagacaatataaaaatataaaaacaccaaaaagaggaagcaaagtttacttttctgcttcctcttccggtttataatcataatcttttaattctgttttctcttctgcttcacaaagatacacatcttccagatgacgttttaatacccgttttcctccggtatctccctctaattccagcaattcttctcggtatttctcatgaaaaattaccggatttccaatttgcccgttccatactactgctccgattcctttttcacttctttgaaagccttccaacagacgaagaatggtctcttgttttaaatgtggctggtctgccacaacaaagcagtaacattctccttttacattttctttatgaaccgcccgaattcctttttttatcgaggcagaaattccatgactgctgtctggattatccactgccaaaaatccatactcttctgctgattttcgaattcgttcatactgggataccacacacactcctgccacatgttctgaatgttgtctcacccagtccaacttttccattagaatttgatacattggtgttttttccatcgaataaatcagcttatttccaccaaatcgtcttgaaaaaccggatgccagcataatcagaaaaaacttctttttttccggcatttccaattttttctcataaatcaccggaacagacagcttttcttcaaatgtttgtgaatcctgctgattaaaaatcactccaatttttctttttgaatttgataaagaaccggttaatttttcaagataccctttttctaacagctttgccacaatttccggcgtcaacagtttttctctacaatccgcctgatttaaaatttcctgtgctttttccagtcggaaacagacttctgataatgggtgattaaatgcctgcatgctctctacaattaaaatatgagttgttatctgataaatcaccggctcatgttctgccggcactttaaagggataatgtttcgctccatctgcttcaataactactgcatcataactttctaacacttcttctaactgtgtttccaaaagccccgcaattttcttttcctgctccagttttcgccctgcaattacaacttttccgggtactcctgcctcttttatggtcttcgtatctgcatcaagaagacctgtccttccaagataaaatggatgctgaatatgcgtacttgttgttaccaatactttcattcccagacctgccagctcatctgccagctttaatacacaagtggtttttcctcctgctcccacaaaagaaaacactggtttttctggcagttcacccattgttttttttatttttttcaacagactcatagacagcctttctcataggcacagactaattctaatacgcttcctgccagacatctcgccttatctgaaatcagggcgcaatgtttctgcgattcttttcttgggtcaacatctgcactcttaaacccttttgtcactggaaaaccatctggtaaaattccacgaatcacacccgtaatttctgtttttacttctattacttctcctgtatctgtttgaacttctccaatacaggctttcgcttctacccagtctccaatatcaaactttttaaaaaacacaccctctgccggtgcatgaatgactcgctcttttccgtatccgccaatgactccgggaatccccgtattttcaattgcacttcctttgtctaaaattttcccaaggtaatgccctcttttggtttccactacataatccacatcttttcctgcttcaaatcctggaccaagtgcaatcgtaagaggtgccatttttcttgttgttccaagattttttttcgcaataattgcatcaattaaaatttccggttttaatagaggaatactttctcctttcgggtcaaccaaaagcaccggatgcagtggttttgcctctttaagtgcctcttttacactattcacgcaaacgcaggttatcccttctacacatgcactgccattttctacagcttccgaaaatgcaaccagacgccggatagctgacggcttatctgtctctaaaacaatcacagaatatccgctttttgaaagacggtgaatcactcctgttgccaaatctccgccgcctcttactacgattggcttcattatcctatcctcctgttttttcatttctttaaggacggatgaccttcgtagctcccgccattttctgtgcaatttcatacatatttgtcacatttccaactacaagcttggactgcatttgataatgatttaagcaagttccacaggctaagatttccacaccatttttttctaatgtttttaaatcttccagactttctgaaccttcacatgcgaggaaaattccgctgttatacattaaaactgtctttggaagctcctctaactgggttaaggcatagatatatcctttgattaaaatttttccaagtacttcatcgccctctcccatcttatttgagcacagtaccaccactgttcccttccctgccggttttacttcctgtggctgttcttcttccgtttttgctgacgagagttctgtcttatcagtcgggacaatatgtacctcatatttcttttcctctaatctggtataggcaaattcacaattttgagaagacgcaaactttctcagattatctacagcaatctgattgtcaaccagaatctgaaatccttctttctttccttcttctaattctttttttgctgccacaaccggtcctgggcatgcaactccaagtgcatcaattactttcatctctaatccctcctaaatattctatttaaagcattacatggtaaatttggtcaaattctatcttcttatttttcattttcgtttctaagactttttctttttccggtaaagtacaccaacataatccacagcctgccgatactacacccggcagaggaatcagacgtcccggaagttcttctttttgacagaattcctccattgcaattgcctgcgtagttgtatgaaaggtaatcaccagcttcatcgtcttttttctcatgttttcatccccttacgcctttcatctttattctaatagaaagcaacaaaaaaaacaagaatagaaaccttctatccttgttttttgtcctacacattatcttgctttttttaatgcagcacgaagcgctgttcccacaatcattgctactacaattttaactaaatctcctggaatatacggaatcactcctgccgcaagaccagctgctgcactcatatgtgcctggaagcacaaccatgctgttccaaatgcatagcagactactgttcctaataccagtccgactgcttccattactttattccccggaaacagtttcatcaaaagccctgcaattaaggtcaggaaaataaatccaatcaaatatccgccagtcggacctgccagttttccaaatccaccggaaaatccagaaaataccggaacaccgaccattccgattaataagtaaaccagataactaattgttgctccattcagacccaacacataaagacttaaataaattgctaagttggtaaaactgattggaaccgggctaaatggaagcggaattgataatggacctaaaatacaggttaccgctgtcatcagtgcaataaatgtcatctgtctggttgacattttctttgttgtatgttctttgttcactgttgctgtattcatgtttttttcctctcttctctttgtttgacttccttagtatatagaattccgtctctaatgtcaaccttttttatttattattagttaacatttattttaacaagaaaacatggataacaattccatgctttctttccagattacttttttcttcttaggtcaattttttgttttcatttccgaagattaagataatccaaaattaactctaccgtttggtcgattccaagcacccctgtatcaatgcacaagtcataatgctctgcttttccccaggtttctccggtataatacttatggaaatccgccctctcctgctcgattttttcaattcttgcctttgcttttgccggactgactccatctcttttggtcaccatgttcactttatccgatttttgtgcatacagaaaaatactcgtacagtctgcatcgtctttgaacacataatttccgcatcttccaaccaaaacacaggattgattttcacatagcttacgaatcctgtcaaaggcacgttttcctctgcatccttcttcctgattcatcgcaatcgcataaagcaggctgttaattggctgttcttcataaaaacagcttacttcttcatatcctgatttttcctttgcaagtttcatcaattcttcttttccataaaacggtattgcaagacgtttcgcaagttttttcccaatttcttttccaccgcttccatactgtctgccaatggtaataattaatctactcatgccttacacactccttttctacataaacccagcaaatacacttgctcctactactgtaagaagtcctgctactgcaattgcaagactgctcatcgctccttcaaccggtcccatttccatagctcttgctgttccgattgcatgagaagctgcgccaagtgccaatccttttgcaaccggctcttcaatgtggaacaccttacagaccgtctcaccgatcatatttccaaggattcctgtaacaatgataacagctacggtaatcgttacaattccaccaagttcttctgatatccccattccaattgctgttgtaatggattttggaagcatggttacatactgttcatgagaaagtccaaataattttgcaagtattaatactccaacaagacttgcaagtacccctgaaatcaatcctgcggcaactgcctttaagttcttctttaataactctaactgctcgtacaacggcactgcaaggcagacagtagccggtgttaaaagataactgatgtattttccactctgattataagattcataactgatatttccaactaccagtactgcaataacacaaattacaccgattaagagcggattaaacactgccatcttaaattttttctttaaaatcaatccgatttcataacctacaagacttaagactgctcctccaaataaagaaacatctaaaaattctttcatttcctcttcccctttctgataattccctgtgtcacaagtccggttaccaccataacaaatactgttgtcacaacagtaataattccaagcggaataatcaccggctgtaagattccccaggaatcaatcagacctgctgctgccggaatgaacataaccggcataatctctatcaaaaaagcagatgcctcctttacctgatgcagttttaatactcctgtcataagtgctgccagcataaacaccagtccatatacacttgccggaatcggaagcggtaacacctgatgaagcacttctcctaaaaaggaaaaggctaaaatgaccataaattgctttaagtacttcataatctttttttcctgttctcctctctttttgtgtttaccaatttaattttcgtctttaccaattatactcttgcgccaaaaaaagtcaatgcaggaatgtaaaacattcttaaaatctctgcattgacctcttgttttaaagttctaaaaatccttttataattacacagctttttactggcgaatataaattccctgttcttcaatgaaatcttccaaatcctgaagagcatcctgcgcccaggtttctgataaagataagtctgccggttttgggaaaaacatcgtttctgccatttcttttccggtttttgtcttaaaaattttctctactgatttttgaatagtatcagcagaatttccgttttcaaaataattgaccagaaaatccgcttctaccaaaatctgataatccatcccatctatatttgtatacgtatgatgatgtcccaccagatacgaaaccctttcaatcacagcctcctcaaacccaatcacacgcatcatcttctctgcctcagccggtccttcctgctcctgaaattttccatcgctctttccatattttgcttctgccggcttgattccaatgtcatgcactaaagctgcgcactctaaaataaactggatttcttcctctaatttttctgcttttcctatcgcctgtgcaaagctgtgtacttttacaaaatgctggattcttgccgggtctcctgcatcataagccatcatttcccgatacagtgtttcttttaatttttcttttgcgtcttgattcatacgccatccaacctttcccttattatcgtaaagaaaatcaaaaaaagcagacaaaaaccttcaaaaagacttctttgtctgctttatttttccattatatcactcttttttgtatgtgtctattgcttttgtttccttaaaattactgtgtcaaaccctgcaattgtcccatcataactgcccagccatacctcaaatccatctttcggaaattctatttctatccggttacaattgaaattttgcacaatccgataaactgctttttcattttcccggctggtgacttccacaccataagggatttctttcattagaacagtaatgttgctgtttttcacaagctttttataaaaatcatcataaaaatcctgttcaaaatctgcacagatttcgtaacattcgcctgcaaaaattcctgtcaagcgaatatctgcaatatgctttgattaaatccccttaaaggaaaatttaaattcttttttctgacttacatccagcagatattccggatgcgttttggcaccccagctgtcatctccgccaacacccatctgctgcatagaagctcttactactgtataatgtactttcggcagttcaaacggatgtgccgcattttcaatttcatgcggagtataaggaagtgcggaaaattccattttatcactcttaaagagcatacctctgccctttctatccgttacttttgcccagcgtacccctgttttatttccacattcctgcggaactaaatattttgccatattttcttctactttattttgataaataccaagttttgcacctttatttctgtctacataagtctcttccggtcccattccataccaggttacctgattatagtctgcatcgaatttgaaaatcacaccaaattctggcatatctcctaagtcttttaccggttcataagaaagtaccgtctcgattgttccatctgcaaatacttcataagaaagttcacattctgcctgtggagtcgtcggcaggcaataagtaaaacttacaattgcagaatgtgcttttacttccagctttggttcatacattccaccctctggttttttatgcgataaatacaggcttgccagtttccactgtccataacgcattggcatcagatttccatagtcattatcggttggcgctctccagaaatttggttttgggatggcttttatcatttcttttccaccatacacataggataccaatccgccatttaagtatgagaacatcactttaaaaccgtccccatggatcccaatattatgtgtactcttaacaacctctaattctccctttggaatctgtgcggctctctcaaccttatacaccccctgtccaaaggcaacttcatgaccacgttttgcccagactgtatcctcttttaacagaaatgctactgttattacatactctcctgacagagtctgaacttcaaacggaagcggatatgtttttttactaagtggtgctacatctgtctcaagttgttttcttgcaagttcttttccatctttttcaagcactgccacacagtcaaactgatttgtattcacaaataaatttttattttcaactgtaacctgtgttttttctacgacagcagtaatattctggtaattgaactttacttcctgcatctttggagatggctctctgtctcctccataagcaattccatttccactaaaattataatcacacggacggtcatcaaagtctccgccatacgcctgaaactcttttccgtaacggtcttttttataaatagactggtcaatataatcccagataaatccaccctgatataacggctctgtatctgttaaatccgtatatttatgcattgcaccacaggaatttcccatcgcatgtgtatactcacagcagataaatggcttgcttctatcctttttcagaaattccttgatactttccacagacggatacatctgactttccatgtcactggtatcattatatcttctgtcattaaatacaccttcataatgtaccagacgggtcgggtcttccttacggtaaaactctgacatttcataaatcacacttccgccaaaggactcatttccacaagaccagataagaattgccggatggtttttatctctttgatacatggaattgacacggtctaacagcatgcctttccattcttctttatcacacggaacaacattggtataatccggatgctcttttcccgcctgagtgtcccagcttccatgtgtttccatattattttcagcaatcatataaattccgtattcatcacataactcataaatatcagaaccatccggataatggcaggtacgaattgcattgatattattctgtttcatcgtcaccagatctttgattaattcttcccttgaaacatgacgtcctgttacagaactaaattcatgacgattgactcctttaaagacaattcgtttgccatttaaggtcataatattgcctttcatctcaaatttgcggaatcccacgcggtatggaatcacttccataagcttctgattttcatcaaacacttgaatgagtaaatcatataattccggtgcttctgcactccataatttaggctgttctaccaaaactacaaacctgctttcactttcaagtgccccttctatatttacaattacttctccgtctttgctcagacaaatcttaacgtttccgtttccaactccttttaaaaccagttccaaatctgcttttgtaaaagtttcatccagtaaagtgcgcactctcatgtcacggacatgtacttctggaatcgtatacagatatacatccctgtaaattccggaaaaacggaagaaatcctgatcctcgcaccagctgctgcttgtaaatttaaatacctgtactgcaagcttgttttccccatctttaagagaatccgttaactcaaactctgacggtgtaaagctgtcttcgctatagcccacaaagactccatttaaccagactgcaatcccactttctgctccctggaaagaaataaaaactcgttttcctttcatattttccggtacttcaaaatattttatataacttgctaccggattaaaatgagttggaatttctcctagtttgacttcttcccagccttcccaagggtactgtacatttgcatactgaggctctccatatccctccatctgaatatgtgccggtacacggatatcatcccagtttttacaattatattctgttttttcaaatccttttatagtgctctcataattttttgcataatgaaatttccaaagaccatttaaatcatatttataattttcttctttttgcaacatcgcttccatggatgcataatatttatggtcggaatgtgcctctactctgttttcctggaaatactctggatcttttactttgccataatcaaaaccgctcatactatatcctcctaaaacctgatttttatcatactttctcagtatatcatatttcctttgacttcgttgattttctcaataaaatctcataatccatcatacttttttgagcgtatttttctccctgtgaactactcggcaactgagttaccagagcatctgaaatctggcgggataccgccttttttcagggtgcgtccatgacaccaatactgcttgcctttcggctatgcagctacttttattatatctggtttttttagtccggttacggacagttctttctgttttccggatacggaaagatatttccgcaggatattaaatgcgcctaccgcatctgcattgtatcttactccgtcagttacatacatgccccgttcttttcggtttgatgcttctgcatatctttttgatacttctggtgataacgggctgcactggctggtatagctttcttcttgttttatcaatgggatcccataccgtttcagcttatattccagcatgatatacaacttattatacggcaggctgtgaaacttctggtttgtcttgtgtcccatatctttttctttccggatatttcgaatgtctcccacaaccacacagcggatctcttcttttctgcagtattctgcgatccatctggtcactttgtgaagataatccttcactgcattctgctttttcctgtaaagtctctggatatgtttcgatgattttggatattttattcctctttccgattgttgtgtataccatactgactgcactctggcgatctctttatgaaaatatctttccaaagagagatattttcttcccaggataaaagcccggccatttccagaatcataacaggtcatcagattatgaatccccagatctatagataagtaatgtccattctgggaaagctgttccggctcttcactctcataaataacaataagggcgcattttccattctccggcggatagatccgcaattgttttatatggtccatgctcctgaaaatcttattttcaagatatagaaatttctcatggatctcgtatgtttcttccatatagcttttcagattctttggcagagacagtcgcagctggtctgaacctttctcatgctggatccccatctgcatatatgtaaccgggatatttccctgtttaaaacggggcggatttggttctttgatccctccagtcttttttaggacataaaaggatttccatgctttgtccagctgcttgcagatctcctgcgctgtctgtgacagaagctgtttataccacagatttcctttatgtgcttttttctgataataccagtcaggatacttttccagccccagctctttataatgacgccgttcgtagttgcagatattccagagtttggaggctacataacacatatgccctatgatattggaatattcctgactgatctttatggatgttttatgtgacagcagcattcctcttcctcctttaagcactgcgcagatagggcttcacactccatcttgaatcaatacgatttgctctgatgttcaatataacggcggatattttcttcagatacagatccgatcgtttccacataataagaatggttccacaaccctcctttccatagctggttttttatttccggaaaacgttcgaacagttttctgccagtgatccctttcaaatacttaacgattgccgttatagaaagttttggtggagctgatacaaagcagtggacatggtcgccttcaccacattcaaataaatgaacagtaaagcccttgtcctcagcaatctgctgcaccagttcctgaaggtattcctcaatttctggttttaatatcttccgtcggtatttcactgaccacaccatatggtagttaatattacacacgcaagttctataatgtattaggttttctttcatgcatatagtatatcatattgaattgtaatgcgcaacaattgtccgaacatattttcgtttttattatataccggttacggcatttattttttatatttatattttaacagaggatgaggattattatactgtttgcatcgtgcagatatgcacactcctgcgctttcatctcggtaattgaattgccgaggattcccgcttattgtcctaaacaatgaatcatctgtgttcccattcggattcccacctgtcttgccggaacactgaccgctgtaatcgacggtgaaaaacagtttaaattagaactgttatataacgaagcaattgcaatatcttttggcactcggtaacctcctgcctgtaatcgtgacatcatccatgtactgattacatcatcaccacatataatacactgtactttttttgcaatcatatcactgataattgtatccagaaaatcaattttcagagcaccggtataataaagctgttccctttcagggattccgttttttattaatgctttataaaatccattgcgtctgctgcgatttacgttaaaagataagtcttctaccacaagcgcaaaccgctcaaatccctgtcccactaaaattgagactaaatattgctttcatagatggaatatacatcctgaaaaagattccaaattcacttaatccatcaattcgtgctgcttcaataatgtccacaggaaaggctttcgcattggtacgagacatcataatcagaagcggagttgccagtgatggaagcataaatccaactgctgagtttaataacccaaatttggaatacatccgaaacagcagaaccttcctcttttttgcttgagccacaacctgccagcaggcttactgccattgttgagaccaaaatgcacgaaattaactttttcttcataataagctcctcctcttttgcgcaatttttatcgctctattttgcacaaaaaaaagaacccttattgcagggttctttttcgaacattaaaatcctaatttctttttaaattctttggtcagttttacacttccaatactttccacacttccagtcattttcagattccaattctcatcaatctgaatccacagctttccacccggcatgtgcaccatcacatcctgaccaacccaacctttcttatatgcaacagctgcggcggcacaactgcaggttccggacgccagaatataaccggctcctctttcaaagatttcaatattaagattatttttatcttctacttgaagcagcataacattaattccatttttaaacatcttagattctgcaatcttttttccaagtttacagaccttttcacggtcgattgtctctgccggaatcacacaatgcggatttccgattgaagcaataaatgcagaatatcgttcttccccaagcgttaccgttttttcctctccaaaactcattttccccatgtctgcctgaatccggcttccatcatcgtttaaaaaacgaacctttacgcttccacctgcagtctccagcgtcagcctctcacttaatgtataaccagcatcttttaaatatcttgcaaaaatccgaattccatttccagcccgctctgcttcacttccatctgaattaaagacacgcactctgatttttttctcttcatccagataaggtcctgctaaaattccatctgctccgactccaaaattccggtcacagattttttttatctgttctctggtcagtacttcttcattttttataacatcatacaccaaataatcatttccgataccctgatattttacaaattccattttattttcccccaattttctattcttctaatttcagaagtctatctattttctagtgtatcagacatctttatgttataatataagtattatgtcaaaaatgttgcaaaaaatgttcaatttatcagaagaaccgaaaggatttaacacttatggaatcagaaacattcaataaagccggatatttaaaagacaatttccgcttatttcatttaacagatacaaactctcttccgatttcctatcattaccatgatttttataaagtatttcttttattaagaggtgatgtcacttaccatatcgaaggaaaaacttatgacttaaaaccttatgatttggttttagtaaatgccggagaaattcataaaccggttattaacagcactttttatgaacgaatgattctatatatttccccggattttttagaacgttataaagaatccggggatttgctggattcctgttttaccaatgcagaaaataatcattctcacgtactccgtgtcgaactatttgccaaaagccgtctttatgaaacactggttgaactggaaggttctcttgcacaggatgactttgcttccggtctataccaaaacacactatttcttcaatttttgatattattaaatcgtgcttccatggattcttattcaagtgcctacattccaaacagctattgtaactccaagattctgccgattttagaatacattgcagaacatcttgtggaagatttaagtattgatacactctcttccaaattttatatgagccgttattacctcatgcatttatttaaaaaagaaaccggatacagcgttgccaattatatttccacaaagcgtctgctccatgcccgcgctttaattcaaagcggaacctctgtcacagaagcgtgctttgcaagtggatttaaaaattattctactttttcaagggcatataaaaagctctttctgatatctgcacgtgaacaccgctaatacagcataaatcaggcctctataccgacgctgtaccagttctgtgtcggtaactgtctgcacctttttcgtactttcatcatatagtaaagaaatgttttttctgactggaacaaacatgaataaaaaaacattcgattttaccatcatcggaggagatatgcgtcaggtctgccttgcaaaattactcgctttaaagggatactgcatctgccactatggtctctgcgaaccattaaaagcgccctgcatccagcctttggattctcttttagaagcagtctcctcttcttctgtttgtattgcaccaattccgttttccaaacttctcaataaaactccttatcttgaatttgctgacctgctttctgatggacacaccctgtttgccggctgtatcccaaagccttttttagaactcactcaaggaaaaaatatctctgcttttgactttatggcttcatctgaatttgcttactggaatgcaaaagcaaccgcagaatccactcttgcagctgccattctcttaagtccccgcacactttttgaaagccgttgtcttatcttaggatatggaaaatgcgccaaagctctcgcccgactcctttctatgcagacaccctatctaagtgttgctgcaagaaaccctgttcagcttgccgaagcttctttgacgggcgcacagaccatttccttagaacagcttttcgattgtgaattatcttcttttgattttatttttaataccatccctgcaccaatcttaacaagtgcccttttagaacagatttctccttctgccttattgcttgaccttgcatctgcccctggtggatttaacctcgaagaagcaaaagcaagggggcgaaatgcacatctgctcttaggactccctggaaaatacgcacctctttcctctgccgaaaaaatgatgtctttcatttttcagcacatcaaaatttcatcctaaataaaaaaggagaggttctttcttatgtcattatctggaaaaaaaataggcattgcctttaccggttctttttgcacctacgcccgaatttttgaagaacttgaagcactccaaaaagagggagctgtcatacagacgattttttctgactctgcacaaagtatcgacagccgttttggaacggctgaaagtttcttaaaaagagcagaagaaattacaggtatccctccaattcttaccatcaaagacgccgaaccaatcggtcccaaaagcctgcttgacctgcttgtcatctttccatgcaccggaaatacacttgcaaaacttgcaaacggaatcaccgatactccggttttaatggcagcaaaagctcatcttagaaatgataaaccactcttattatcagtctccacaaacgatgcccttggtttgaatatgaaaaatatcgggcttttaattaacgcaaaaaatattttctttattccatttggacaggacaatccagtcaaaaaaccaacttctctgatttcacatccagaacttctgattccatctattgaatcagccttgaacaaacaacagattcagcctttaatcaaagcctggtaatcaactcaccacttatagaattggaaaggagtatctctatgtgtggaattgccggattttgtaatccaagaaacgattttatgcaatctcaaaacaaatggatttctattcttgaagccatgaaccacacccttaaacgacgtggtccggatgatgagggaacgtatctttcctctcactgtggtctctctcatgtgcgacttgaaattattgacttattaaccgggcatcagcctatgataaaacaatgcgcctccggaaattattcgattgtctttaatggcgaaatttataacatgaaacctttgcgggaagaactgaaaaaagctggaactgtttttatcactaacagtgacaccgaagtaattttaaatggttttatgctttatcgggaagactttatcaaaaaattaaacggtatctttgcaattgcaatttatcatgcagaagaaaaacgactctggcttttccgcgaccgtatagggattaaaccgttattttttacgataacggataatacgcttgtttttgcatcagaaatcaaaggactctttatctatccgggaatcaatcctgtcgttgataaaaacggtctttgcgaaatctttgcccttggtcctgcacgtacttgtggaaacggtgtttttcaaaatatctttgaactgcttccaggtgaatttttaactttttccatagacggattaaacagacagttttattggaaattagaaagccgtccacacgaagattcttttttggaaaccatcgaaaaaacggcatggctgattgaagattctgtaaaaatgcagatgctttctgacattccaatctgtacttttttatccggcggcttggacagtagtctggttactgctatttgcgcaaaagaattgcaaaaacagaaccgccgattaaatacgttttcttttgactttaaagataatgcgaaatattttcagtccaactcttttcaaccaagtcaggatactccttgggcgaaaaaaacgagccaatatcttaataccgctcatcaccttttagaatgtgataacacagcccagtttgagtgtctgttccgtgctgtagatgctgccgacctgccatgtatggcggatgtggaatcttctctgttatatttttgttccaaagtaaccgcctataataaagtcacgttaaccggagaatgtgcggacgaaattttcggcggttatccatggtttcatcaggaaaaagcatttcgtactcctgctttcccgtggtcctctgattttgctcctcgaaaacttctcttgtccgctgatgttcttgccacacttccaatagaagaatactctgcctctgcttatgaagcaaccattgccgagactccacgccttttatcggattccccaacagaaaaacgcagacgagaaatttcttatctcaatctgcgctggtttatgatgacacttttaaatcgtatggaccgcaccagtatgtattccggcttagaagcgcgcgttccgcttgctgattaccgcattgtcgaatatgtttttaatgttccatggtccatgaaatgtcccaatggaatcgtgaaaggtctgcttcgatatgccggttctgaatttcttcccgaagaaattttgtggcggaaaaaaagcccttatccgaaaacttatgaccctgcttatgaaaccctcctcgctgaccgtctaaaagaagtgcttgcttctccaaatgcaccaatccgtaccttactggatacaaaaaaagttcatcaatttttagaaacaccatccgattataccagaccatggtatggtcagctcatggccggaccgcagatgcttgcttatcttttgcaggttaattactggctggagcactataagattaaactggtgtgaacaaaaacactttaccctatccgtattttcctaacaggactcttgttttacttcacagactgtcagacagtcgtcctttaccctgaagcggatttccattcctgcaaacgggaatccataaatccgctcggggtcttgttgataagccggtctgggatcttgttctaatactgcataaagcgccggtcttttttcttctggcacaagtctttctaactcttctggaatatcaacctttatcctgtcattttgatgcacacttgcaaaactaccttctgcttccggatgacaatccgaatacggaatataaggtttgatatcaaaaattggtgttccattcatcaaatctgcaccctttacataaagaatcggtctttctttttcatcaaattctatcttctctaaccgaacacaggataatcccattccatttggacgaaatggagagcgggttgaaaatactccttttctcgtatttccgcctaatttcggtggtctgaccgtcaaggaatagttttcccttctattttcggaaaatccccagataagccagatatgagaaaattcttcgagtccttttacagcttctttcgtgccatattccggttcaaataaaatctttccttccaattcttcgaccagaccgctctgtctgggaattccaaacttggaagaaaaatccgtaacaatgtgtgcaattgcctgaatttcatactgttctttcatcttatctcccctcctcgtccagctttccaaatgcaccattcggtatttccggataatgtttcaataattcttccactgccattctatactctttaagattttggcaacgtttgattttggtgttccagatgtccatctttggaaatgaataccgaagatagcaccagatttcctttaatttaaacaaggctttctcttcattgactgcattttcggtgaaatcctgataaagacgctccaaaaatgccccccaaacttcaagtgacggcaattcttgtccatgaattacggaaagcagacctggatttgcaagtacacctcttccgagcatcacgccatctattttcggaaatcgctttaccacgtcttcataatcctctttggtaaaaatatctccattatagattaacggtttttcattcttttgatatacacctgcaaacgcatcgaatcgtggactccctttataataatcagtctgaactctcggatgaacaattaattcctcataaggataattagaaaaaagttcaaatagttcatctatctcttcctcatgataacgaccaagccttgtcttaattgaaatttcgattggacatttatcaaaaatctcatctaaaaactgctttaatttttctttcttttctaaaaatcccgaacctcttccaccatttaccaccggtcttgacggacagcccagatttaaattcacttcttggtatccatattccattagtccttttacggttcttaaaaaatcttcgctctgattcgtcaatatctgtggaaccagatacaaattttgattattttccggaagaatatcccgtttttctctataattaaacaggcgccccttatttggctttgcagaaataaaaggtgcaaaatatttatccatcggtaagaaaaatgcatgataagcatttctgtaaattgcctctgtgacctcctctaacggagccatataatacttcattcttttagtttcctctcacttttctcttcaagtcgaacgcagacattatatcagagctgtccgaaaaagtatagtttctactcttctttttctattatttaaaattttttcaaaaaaatgcttgcttttttattacttctatgctattataaatctcggttgtaacactaataaaacttaaaaatctggctccatggtcaagcggttaagacaccgccctttcacggcggtaacaggggttcaaatccccttggagtcattaaggcgccatagccaagtggtaaggcaaaggtctgcaacacctctatcaccagttcaaatctggttggcgcctcttattcctccttagctcagtcggtagagcatgcggctgttaaccgcagtgtcgttggttcgagtccaacagggggagttttttattgcccagaaatgcgcatcgatgaaataagaattcatcgatgcgttttttatttgaaaaatccattctttaatcactttaagtcctaacgcacacagattgcatcttctcttacttccacaatctcagctacccatgctgcgtgtggaatcgtcagatattctgccatcgctggttctatagtatccccatcaatggtctgtctcccacagataatcaaatctgcgtcgccaatcacctggattccctgtgcaagcgcctaagaagttgccaagacatctgcccctgcaaattttcggtcagaaagaatcactgcgtcatctgccccatctcagctttaacttcttctatacttcttcataagtttgagttacaaaaaaagtcctaaaacaaaatgtttcaggactttttatttagaggcgccaaccagattcgaactggtgatagaggtgttgcagacctttgccttaccacttggctatggcgccttagtgactccaaggggatttgaacccctgttaccgccgtgaaagggcggtgtcttaaccgcttgaccatggagccaaatattcaattgttatcgtaccttcaaaactacatatacaaaaccgaaaccatgcagacacttgccgctccgctgatttctcagcttctggtcaagctctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctctcagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcctttggattgtcacacggtttttcctatgtgactcctccttcgcttgccccgggattccattcccgggttgtgctttccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtattactacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctctagcgcttaaccttgccagcatgcacaactcgccggaccgttctacaaaaagtacgcggttccgcatgtaaagcggttccacagcttgtaaacacagggtttcaggttctctttcactcccctcccggggtccttttcacctttccttcacagtactatgctctatcggtcactaaggagtatttagccttacggggtggtccccgttccttcccacaaggtttctcgtgtctcgtggtactctggatcctgtcttgtcctctttcctttcccatacggggctttcaccctctctggctggctttcccaaaaccattctggtagaatcaaggaatcaattatacagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagatatctccggctcattggatatttgctcctccccgaagcttttcgcagcttatcacgtctttcatcggctcttagtgccaaggcatccaccctgcgctcttttttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacgactacggcagtaaaactttcgttttcttaccgagtggagataaagagattcgaactctcgaccccctgcttgcaaggcaggtgctctcccaactgagctatatccccatatttatttttttcctctgggtattacccagtgggcttaagtggactcgaaccaccgacctcacgcttatcaggcgtgcgctctaaccagctgagctataagccctcttttgtaatccggcagccacctgctttcccatgccgtctccagcatagtatcatcggccgcttaagtcttaaccatcgtgttcgggatgggaacgggtgtctcccctaagcgcatcgccaccggaaaggttttgttattaaattttagaagttttccttccttaataactcaacagtgaaacacttcttaactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcctccaggttatccctggcagtctccacagagtgcccagcttcacctgctggctactgaggataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacaccgtatcatgcgatactgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggccatctatcccttttactgttttggttcatcgaaccgttcttttttaaataaatgaatgtaaaagaattttcgttttcatgtgtttcactgttcagttatcaaggttcctgtcgttctttttatcagcgacagcttttatattatatcaaagctgtttttgtttgtcaagaacttttttaacttttttcaaagttttttatttttgatttgttgtcgttttcctcgacatcttttatattatatcaaagctgtttttgtttgtcaagaacttttttacttttttttattccaagtaattctttttcttgtcgcaacagcttatttagaataccatatctaacataacttgtcaacaactttttcaatttactgataatttagattaagttctgtatttttcagtcatttgttagtgacaactctgatactatatcacagcctttctctgtttgtcaactagatttttaacaaacttttctttttcatttcgttttcattatattcgattttccgaatctctttttttgtatgcttgacaggagatttctctaatgctatactcaactttgaaattttatataatagacagttcgtttgcaccatcctgtctttaaataaaaccagggctatgtatattgtttcattctttgacatgatgcccattttgtgcatcatgtctttttaattttaaagaaatttctttattatcaaaaacaatatccatatccgtaaacgaacggaaaggatgattatgtatctattaaaaacagagcagacttttgactccgctcactttctttctgattatcaaggcaaatgtcgtaatcttcatggacaccaatggcgggtaatcgttgaaatctgtggcaaaactttaagcactgatactcagacccgcgatatgcttgtagactttggtgatttaaaacatgacttaaaaacagaaactgatttttttgaccatgctttaatcattgaaaaaggcagtcttaaacctactactttaaccgctttacaggaagaaaatttcaaaattgttgaactcccatttcgaccaactgcagaacgcatggcatcttatttttatacaaaaatgaaattccatggctacactttaaggcgggtaaccgtatatgaaaccccaaaaaactgcgcgatttatgaggagtaatcaaactatgtcaactcaagcgatttatgatgttgttgaaatttttacaagtatcaatggagaaggtccattggtcggacaattggctgtttttattcgaatgaaaggatgtaatctttcctgcagttactgcgataccaagtgggcaaacgaaacagatgcccctgcaagagaaatgacggcaaatcaaatttatcaaaccattttagaatccggtattaaaaatgtcaccttaactggcggagaacccctttaccgtccttttataaaagaactcttaaaacttctggcatctgattcttctcttcatattgaaattgaaacaaacggaagcataaaccttgaaccattttgtgatttaggaacttctgtttcttttactatggattacaaactctcatgcagtaacatggaacaaaagatgtgtttaaataatttttctattttagagccaaaagatacagtaaaatttgttgtaggttcacttgcagattgtcaaaaagcatttgaaataatacagtcctatcaattagaaggtcgatgccacatttatctcagtccagtgtttgggatgattgaaccctctcagattgtagaatttatgaagcagaataaaatgaatggtataaatcttcaaattcaaatgcataaggtaatctgggaccctgaagaacgaggcgtttaactatatattccgagaatacctaaatttattttcatgatggaggttatttatttatgaaagctttagtattatccagtggcggggtagacagcacaacctgtttaggtcttgccatagaaaaatatggaaaagaaaatgtgattgcacttgcaattacttacggtcaaaaacataccaaagaaatcgaggcagcgagagctgtcgctgattattacaatatagaaatgttacattttgatttgtctactatttttcaatatagtgactgttccttgttaagtcattcttctcaggaaattccagaggaatcttattcagaacagctaaaacattcggatggaaaaccggtttctacttatgttccatttcgaaatggtctgtttctttcctgtgctgcaagtatcgcactttcaaaaaattgtgatgtaatctattacggagctcacagtgatgattcagccggaaatgcttatccagactgtagtgatgcatttcaaaatgctatgaaccaggcaatttatgaaggaagtggacatcaattaaaaatagaagctccttttgtaaatctaacaaaagcggatgttgttcgtaccggacttgacctgcatgttccttatgaacttacctggagctgttacgaaggtaaagagaaaccttgcggtcattgcggaacttgtattgaccgtcaaaaagcatttgaacaaaatggtgtaacagaccctgctctcgcttaaatataatatattgcaaaaaaatctagactgttcccttattattaattgatattatcgacagcctagattttttttaattttcagtatacacaaaaaaccacctatttatcatagatggcttcccaaataaaaaagctccccctgttggactcgaaccaacgacactgcggttaacagccgcatgctctaccgactgagctaaggaggaatattcattcatcgtaccttcaaaactacatatacaaaaccgaaaccatgcagacacttgccgctccgctgatttctcagcttctggtcaagccctcgaccgattagtagcagtcagctccatacattgctgcacttccacctctgccctatctacctcgtcgtcttcaaggggtcttacttctcacgaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctctcagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcctttggattgccacacggtttttcctatgtgactcctccttcgcttgccccgggattccattcccaggatgtgctttccacacgtgtccccacagttctgttctaacgcagtacaggaatctcaacctgttgtccatcggctacgtctttcgacctcgccttaggccccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtattactacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctttagcgcttaaccttgccagcatgcacaactcgccggaccgttctacaaaaagtacgcggttccacagcttgtaaagcggttccacagcttgtaaacacagggtttcaggttctctttcactcccctcccggggtccttttcacctttccttcacagtactatgcactatcggtcactaaggagtatttagccttacggggtggtccccgctccttcccacaaggtttctcgtgtctcgtggtactctggatcctgccttgtcctctttcctttcccatacggggctttcaccctctctggctggctttcccaaaaccattctggtagaatcaaggaatcaattttgcagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagatatctccggctcattggatatttgctcctccccgaagcttttcgcagcttatcacgtctttcatcggctcttagtgccaaggcatccaccctgcgctcttttttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacgactacggtagtaaaattttcgttttcttaccgagtggagataaagagattcgaactctcgaccccctgcttgcaaggcaggtgctctcccaactgagctatatccccatatttacttttttcctctgggtattacccagtgggcttaagtggactcgaaccaccgacctcacgcttatcaggcgtgcgctctaaccagctgagctataagccctcttttgtaatccggcagccacctgctttcccatgccgtctccagcatagtatcatcggccgcttaagtcttaaccatcgtgttcgggatgggaacgggtgtctcccctaagcgcatcgccaccggaaatatgttgttatctgttttttattgataactcaacagtgaaacacttcttaactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgagctcgcttccctttgtttacgccattgtagcacgtgtgtagcccaaatcataaggggcatgatgatttgacgtcgtccccgccttcctccaggttatccctggcagtctccacagagtgcccagctttacctgctggctactgaggataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctagggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcgacgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacaccgtatcatgcgatactgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggctatctatcccttttactgttttggttcattgaaccgttctttttaaaataaatgaatgtaaaagaattttcgttttcatgtgtttcactgttcagttatcaaggttcctgtcgttctttcttatcagcgacagcttttatattatatcaaagctgtttttgtttgtcaagaacttttttaattcttctttttaagaaaaattaaacggagaaggagggatttgaaccctcgcaccgctattaacggcctactccctttccaggggagccccttcagccacttgggtacttctccaaatgcctaaatgatattttcatttagtgagcggagagagtgggattcgaacccacgcgcccttgcggacaaacggttttcaagaccgcctcgttatgaccacttcgatatctctccatctttgttttattctgtttgtttatcgctctgtgttagcgacaagtgatattctagcaccagttgttccaaatgtcaacactttttttgattttttttatttttttattttttccgtttttttattctttttgttttattttatcagggaaagatttcgccctctttccctgatatttactggaatttttaagctttttactcctgtttggcaaagtttttaaaagtgattctactcttcctctaacgtctccaaaatctgctccgcaagtaaaatatcttccggggtcgtaatttttatattatcataagccccttcttccaacttcacttttaatgaaccatattgttccattaccattgcatcatccgtaattccctgcattccttcctgctttgccttttgatatgccgaataaatttccggataggagaaaatctgaggagtctgaatattccagactcgagcccgttttggcgtagattctacaaatccctcttcatctgcaatttttactgtatcttttgatagtacgcctaaaacacacgctccgcctgcaatcaccgctttttttccgcgctctatcatttcctctgttacaaatggtcttgcaccatcatgaataaacacataatcacagttttgacatgccttaagtccttcataaacagaatcatagcgttcttttccacctgtaacgactgcttttaccttttggaatccaaacggctctacaatctctctttttacatattcaacgctttctgcacctgttacaataatgatatcatcaatttcactgctcttttcaaaacaagaaatactataaaacagaaccggtttcccttttaacaaaagaaactgcttctgtattttactcttcattcgttttccctggcctgctgccagcacaattgctgtacagttcatattatcgccccttatactaacgttctcccaatttcaggtttggaactgcatttaaatccattccatgtctcgttccctttaaaaattcgtaatacgcagccacaccaatcattgctgcattgtccgtgcagaaaattggtgatggatgataaaattttatctgattttttttacatgcttcctccatcgcactgcgaagtccgctatttgatgcaacccctccggcaatcgccagttttttaatatgataatcttttgccgccataattgcgtgttccacaagtacctcaaccacacagcgctgaaaagaggctgcaatatctgctgctacaatctcttccccctgcattttgcacttgtttaaatgatttaataccgctgattttaccccactaaagctaaaatcataaggagcatcttcaatcttggcctttggaaaatcaaacgcataaggatttccctcttttgaaagtttatcaattttcggtccacctggatatcccaatccaattgctcttgcaactttatcaaatgcctcacctgctgcatcatctctggtacgtcctaaaatttcaaactcaccataatcttttacaataaccagatgtgtatgacctcccgatacaaccagacataaaaatggcggttctaaatccagattttcaatataattggcagaaatgtgcccctcaatgtgatgcacgcctaccagtggtaaatcttttgcaaaactaattgcttttgcctctgccactccgactaaaagcgcaccgacaagcccaggtccataagtcaccccaatcgcatctaaatcatctaaagtaacccctgcttcttttagcgcctcttcaatcacctgattaattttttcaatatgttttcttgatgcaatttccggcactactcctccataaagtttatgaaggtctatctgtgaagaaatcacatttgataaaatagtacgtccatttttcacaacggatgccgcagtttcatcacaggaactttcaattgcaagaattttaatatctttttgtgtttctgtctccacgtttttttctcctttcccatgtactccattccaatgtacgctcgaaatttttctgttaaaagctctcaaaactcaaaacgtacctcaatatctacaatatctatctgatatcatcttaagtttctgctactcttcttcaaactgcagttctaccgactggcgatctcttgctgcaatcgtattttggaaaatttttgttgcctctcccaatgcttcttccggtcttaccagtgacggactgtaatgtgtcagccagagttcctttacattggcactttttgctaatgttgcagcttctttaaacgtcatgtgtttatgtgcctttgccttttcctcttctttatcctgctctccatacattccttcacagataaataaatctgagtctttcgcatgctcttctatagatttgaccggtctggtatctgtcgtataagtcagtttaattccctttcttgccggtcctaataccatatccggagtataaagcatgccatctgcctctactgtctcccctttttgcagtggattccaatattttaacggaatattctgttcctttgctctttttgcatcaaattttccatttctcttaatttctatcgtatatccataacaaagtacattatgatttactttatatgccgtaatctcatacccatataaagtaaaagtctcttccgactgagtcaactcaatacattcaatttcaaaaggcagttccggtgcaatcacacgaagcgcatttaccacacggacaagaccttttgggccaatcaaagtaagaggctcggttcgctctgcatttcccattgtcaaaagcagtcctggaagcccactgatatgatctgcatgataatgggtaaaacaaatcacatcaatcggcttaaaactccagcctttttcctttacagcaacctgagttccctctccacaatcaatcattaaattacttccgttatagcgtgtcattaaagcagttaattttcgtcttggaagcggcatcattccaccggttcctaacagacaaacatccagcatctatcttttatcctcatttctctctgattttgcagagatatctgcgttttttatcttaacacacatttttgactgctacaacaattccttttcttttttcacggtaagtggaattacaaaatctgcggttattctatcatagcacgcttcacataaatcaaattcatggtgttctgtatctttatttgaaaaatatccccataaaatctctccatgaaacattccttcctgaatcatttcgttttttatggttattttttttccacatccattacaataaatttctgccagttttttttctttttgatttttatattttctcatccttatcctccaaacggatgtcatatactttcaaactctctctttttgatttactttgtactctcgacttgtttcttctgtattataccgaatttttttcaaaaatcctatatgaaaccattttcaaatatagaaaaagatagcaattctgctatcttttacacataacgattccatcttcgaccggctcttcataaaactttttccgcacatcaatctcttcaaatccaaaggaacggtataactttcttgcacgtagattactctctcgcacttctaaaaagaaagacatcccccctctttttttcgcttcttttaaaaattcctccataagatgtgttccggctctttgtccccagcaggactttttaattgacacatttgtaatctcgccctcatctaatacaagccacattcctgcataaccaatgatttcatcttgattctcaatcaccatgtacaacgtatttttagaacgaactgcatcttcaaaatccttttgcttccacggctttgaaaaattttcagcttcaatttgagcagtttcttctgcatcctctattgtcatttcacgcacttttaataaattttttttgatattctcactcatgtttttcttgtttcaaacgttctgcacgttctctttctgcctgagaaacacgaagatactccggcttatgttctgctgcactttctgtttttccctctttaaaataaagagtaccaagcatgccaaccgcccctgcacgctgtctgcttaaatgtgccggtgcaaatgaatacggcactttacagctttcctgaatcaattctttataaaccggaacagcgtcgccaagaaaaattaccggtctttccatttgatttaattcttttatcaattcctctaatgcaactgcatcctgttcttttaccacctgcatctgatgatttaaaaagcaatacattcctgtataaacctgttttcttcttgcatccataatcggacagataatcgtatcttcatcggtatcatataaattataagctagtgcatctaccgtcggcacgctgattaacggcttatctaatgcaagtcccagtccttttgctgtcgccgaaccaattctaagccctgtaaaagaacctggtcctgctgccactgcaattgcatcaattgaacttaaattcaaatcaatactcttttttatttcttctaacatcggaagcaaagtctgggaatgtgtttttttataattcatcgtatactctgccacaagtgtttcttcttctatcacagccacagaagctacaagccccgaactgtcaattgctaataatttcattgtcttctctcctctctggtttcttgttctgcttttttattccatttctgtcttagctaaaccatctattgtgatttttcgataatcaaatcctttttccggatttttttcaattgtaattgcaatgatagactccggcaaaagctcttctattaattccgcccattcaatcaggcaaattcctttcccaaaaaagtaatcatcgtatccgatttcttccatttcttcaatatctccaattcgatagacatcaaaatgataaaatggaagccgaccgccttcatattcttgaacaatcgtaaacgtcggactgtttaccggttctttgattccaagtcctacagccactccttgagtaaatacggtctttccggttcccaaatctccatttaaggtataaatctgtcctgcaaccgctttttctccaagccgtttcccaagttcaaatgtttccttcgcactatttgtttctattatcatattttgactcactttctgtttctatacaaaatgacatcattttctgtttctttcatccgagcgagtattcgtcagaatatcgttacggtaaaacagacatttgcaatccgctttgttacttgctcaccacttagtgatctgcgcacttgaagcaggagaatgcttatctgcggtaaagcggacattcgcaatccgcttcgctacttgctcatgaacgcagtcgcttcgcgatctgtcagtgggagctttcaactcccactgacagaagcatccccctcacccgccgtttagtgctctgcgcacttgaagcggggggaatgcttatctgcgttcaaatctcgattctacattataacacagaaaattatggcttgcaccttttatttttccagattataatggtatctgaaccttttggtgctgccggttttattgttttgataagactttttaagtgcagtaacctgttcgcaaaaaaaattaaaggagatacaaattatggctaatccaattgtaaccatcacaatgacagatggcagtgttatgaaagctgaattatatccggaagttgcaccaaatactgtaaataactttattagtctggttaaaaaaggcttctatgatggtcttgtattccacagagtcatccgcggatttatgattcagggcggcgacccacagggaaccggaatgggcggtcctggctattccatcaaaggagaatttacctataacggtttttccaatgatttaaaacatacaccaggtgttctttccatggctcgcgcaatggatccaaattcagccggaagccagttcttcattatgcatgaaacttccccacatctggatggacagtatgctgcatttggaaaagtaactgacggacttgacgtggtaaataaaatcgctgaagttccaactgactacagtgaccgtcctcttgaaccacagatgattcagaacatgactgtagatactttcggagttgaatatccggaaccggaaacggtataattttatcagtcttcaaatgtaagaacttctttatcaagaatggcataatacagttctttttctgccgtgacagaagcttttccgctcgttgcttccgtcacggctttttttatgcgttcttcttcttttttcggaactaatacttcaaattctacactttctgtatatcttgaatctaaaatcggaagattctcctgcccaaacagatactgcagttttccgactccattataatctgttccaactaacagacatactccatggtttttggtaattaaaatactgttttttaatccttcctgaacggcttttgaatatgcccttacaagtcctcccgttcccagcagagttccgccaaaatatctggttactacaaccgcaatattatacagttcttctccaagcaaaacatcaagcattggttttcctgccgttccctgtggttctccatcatcactgcagcgcataaactcttttctttctccaatcacataagcatagcagttatgtctggcatcccagtatttcttttttatctcttcaataaattttaaagcttcttcttctgtttttaccagacggacagttgcgataaaacgtgactttttttctacgatttcgccctctccgccctgatagactgtcctatattgttctaacatctttcttatccttacctgattctttttaaattttcttcatcataccacagaaatttacaggtgcaaagcaataattttcccctgaaaagtatcaaaaagtgtgaattttatcaagttagactttatttcgcacagggcatttgctataataaaccggtaaaggaggcaaaatacatgaattttggaaaacgtgcgacaaacagaaaacgaaatgccctgtcctcccactccacaatgatagggaaaaaagcaaatgtttctgttctacgcattctgtttatttcactgattgcagtttttaccatctgcttatgcatcggggtaggagcttttcgaggtctgattgacagcgcaccggatatcaatgatgtcaatatcatgcctgtcggctctgcaactttcatttatgactcagacggcaatcagcttcagaaactcactgcgcctaattccaatcgtatgccggtatcgattgaccagattccacttgatttacaacatgcagttgttgcaatcgaggatgagcgattctacgagcataacggaattgacctccgcggtattatgcgtgccgctgtaaaaggtattacgcatggattcaatttttcagaaggtgccagtaccattacacaacagcttttgaaaaataatgtgtttaccgactggacaaatgaatctacaattgaacgttttaaacgaaaatttcaggagcagtaccttgcagtccagttagaaaaggaactgaaagacaaacagaccattcttgaaaattatttgaacacaatcaatcttggagatggaaattatggagtgcaggcagccgcacacggatattttaataaagatgtcaatgaactgaccctttcagagtgtacggttcttgccggaatcagccagaacccaacccgctataatcctgctacaaatcctgaggaaaatgcaaagcgtcgaaaagaagtactcgaccacatgcttgcccagaattatatctcgcaggagcaatatgatgaatgtcttgctgacaatgtttatgaaagaattcagcaggtagaggcagaaacttctcaggaagacaccacttacagttactttgtcgatgaactgaccaaacaggttgtcagtgacttaaagacccagaaaggatattctgaccagcaggcttacaatgcactttacagtggcggacttcgtatttatacgactcaggaccctaatattcagcagatttgtgatgaagaatattcgaatcctgccaactttccttctggtactcaggtggaactggaatatgcactgacaatccgccgtccgaacggaacggaagaaaacttcagtcaggaaatgatgcagtcttatttccagcagcaggaaggagaaaatttcaatctgctctttgacagcgcagaacaggctcagaattatatcgacacctacaaagctgctgttacctatgatggctctgaagtgctctcagaaagcattacaatggcacctcagccacagtcatctgtggtaatcatggatcagcacaccggatatgtaaaagcgattgtcggcggacgcggggagaagaccagcagtctttccttaaaccgtgcaacatccactctaagacagcctggttctactttcaaattagtatccacttatgcacctgctttaaatgaatgcggaatgactcttgcaaccacttatacagataaaccaatcacttataaagacggtacaccggttaagaatgcaacaaattcttatcgcggagaaacaaccatccgcgaggcaattattcattctattaataccgtagctgttcagtgctttaccgatgtcactccacaacttggatatgagtatctgaagaaattcggatttaccactgtttatgacaatatcagtattaatggtaagatttatactgacattcagcagccaactgcgctgggcggtattacgcgcggtgtcagcaatctggaactgactggcgcttatgctgcaattgctaattccggaacttatatcaaaccaatgttttatactaagattctggatgaggacggaaatgttgtcatcgacaacactccggaagaaagaaaagtcattaaaccaagcactgcttatcttttaaccagtgcaatgaaggatgttgtaagcgaaggtaccggtacaagacttcagctttctaatatgcacgttgcaggtaaaaccggtacaaccgatacctacaatgatgtatggtttgcaggattcacaccatattacacctgtacaatctggtctggatatgacgataacaccaagatcccggataccggaaattacagaacctatcatcaggacttatggaatcgtattatgagccggattcatgaaaatctcgaagataaagattttgacaagccggctactgttggtgaagcaactgtctgcaaagacaccgggatgcttccaacttacaattgtccgactgtaacagaactgtttgataccaccgaacttccaaccaagcgctgtaccaaacatggcggtggtggtagcagccgaagctatagttcttacagttcaagaaattcctacagttattcggataatgaagatgacgacgaagaagatgataccgattcttcttcctctgatgacgaggaagataataccgataacgaagaagaataaactgtaaaaatttaaaaacacaacaaaaaagactccgttctcgaaaaagttgagaacagagtctttttatttactatcctgattttttactacaatcttcttaattatctttgcttaaaattaattttgcagctccataaattccagcatcatttcccagtgttgccagtttaatcggagtttctttgcttgcagtaaatgcatgtgctttataatatttttctactgcatcaattaaaacttgtccggcttttgataccccaccaccgattacaaatacatcagggtcagaaacacaggcgaatacagccagtgcattgccaagataagcagcaaatttatcaacaattttacctgccagtacatccccttctttataggcatcgaatacactctttgctgaaatattttttacagttctaagcacagaatcttctgcttcactttccagcgcctcttttgcaagacgtgcaataccggttgcagaagcatactgctccagacaacccttatttccacagttgcatgctttggtttctgccggatttacaaacgcatgaccgatttcaccacctgctccgtgtgctccggttacaattttttcatttatgatgattccaccgcctacacccgtacctaaggtgaccagaatcaggttctttgcaccctgtccgccacctttccacatttcaccaagcgctgcaacatttgcatcatttccggcttttactgcaagtccggttaaatcaccaagttctttttcaatattttttcttccccaatgaagattcacggcgcatggaatttctcctgtttcttctaccggtcctggtacaccgattccaacacctgcaacttctgccttatcaattttcttttcttcaatttttgcaagaattgttgccgctatatccggaagaattgcttctccattattttctgtacgggtcacaatctcccatttttcttctactgttccatccgtctgaaacagtgcacattttacagttgtaccaccaaggtcaattccaaaacaccacttttccattattcatcttcctcttttctcttttttgacatattttcctgtacacgacgatacagttcctgagctgcattatagcccatcttcttctgtctgtggttaaccgcagccgactctacaataacagccagatttctacctggacgaattggcagagaatggcatactacacggtttcccaaaaattcagtatactcttcttccaatccaagacggtcatattctttgtctttatcccactcttccagcttgataaccaaatcaatagactgagtatcttttacactttctacaccaaacagggtctttacatcaataattccaataccacgcagttcaataaagtgacgggtaatatccggtgcagagccaaccaatgttgcatcactgacacgacgaatttctacaacatcatcgctaaccagacggtgaccacgtttgattaactccagggcagcttcactcttaccgattccactttcacccataatcagtacaccttcaccatatacatcgactaatacgccatgaatggaaatgcacggtgcaagctctacattcaaccaacggataatctctgccataaaggtagaagttgtctggtcagttacaaaaatcggcacatcatatttaattgcaagattaatcatatcttcatccggttctgtctttgtactgaaaatcacacacggaattttacttgctacaaaacgttcaaacgcttccatcttcttttctctggataaatgcagaagatatgtgtattctacatatccgataatctgaactctttcattttcaaaatgttccagatatccggtcagctgtaatgctggacggttaatatccggcagggtaatcctcttttttgagatatccacatccggtgttttattatgcagatttaattcctgcaccattttgcttaattgtacacctttcactttttaggcctccttgttttccctgaacgcaaccttatgataaactattttttgcgcacattcgctttgataatagtttatcataaggtgtttagaagttcaactgcaaccatatcaagaattcgtcaacttatgccgtcaaaatcatatgtcagttcttacaaatgtttaacttaaatttcacgcatttgctttatgaaaaaagtcatacactgcctgcgctgacttttcattcatcgaagaaacttcagccagttcttccactgttgcctcttttattttttccacacccataaaatgtttcatcaaagcttttcttcttgccggaccaatcccttcaatctcatcaagcacagaatgaatctgatttttacttctcaaagaacgatgatattcaattgcaaaccggtgtgcttcatcctggattcttgtaatcaatcgaaacgcttcactgtctttttcaatcggaatttcctgattttgataataaagacctctggttctgtgtttatcatcctttaccattccacaaaccggaatctcaagttttaatttttcaagcacggacaacgcagaatgaacttgtccctttcctccatccattagaatcaagtccggaaatttcgtaaagcttccatactgttcttcctgatttttttcttcttgctgttgtttttcttccattccatgttcaaatcgtcttgtcagcacctcttccatgcttgcataatcatttgaaccttccacagtctttatccgaaatttgcggtaatcactccgctttggttttccattttcatacacaaccattgaaccaaccgacaaaaatccactgatattggaaatgtcataagcctccattctctgcgtacttgaaagatttaaaagtttactgatttcttttaccgccccgatggttcgtccttcttcccgctttaatcgttctttatctttttcaagtaccagcctggcattattttttgcaagttctactaatttttcttttgttcctttctttggcacacgaatctgtacctttgttcctctgcggtttgaaagccaggtttcgattattacacgatcctcaatttcgctctcaatcataatttcctttggaatcattgcagttcctgcataaaactgtttgataaaactcgataaaaccactgctttttcttctcctgccgtgtgtaaaaagaaatggtctcttccaatcatttttcctccacggataaaaaatacctgagctactacatcgtcattttcctgtgccactgcaatcacatccctatcttctccatgctggtctgtgattttctgacgctctgcaatcttttttacgctctctatcaaatcacgatactgtgccgcatcttcaaaacgcagttcttcggacgcccttaacatcttttgttccagttcttttaaaatttctttatgatttccattcaaaaacgaaatcagctcttctacctttttatgatactcctcttttgaaatatacccctgacaaggtgcctcacactgatgaatctgataatacagacagggtctttcttttttgatgtcctttggcagatttcggttgcaggttcttaaatggtatagttttgttacaagctccaccacatcttttactgcaagaccgctggtatacggaccataatactttgctttatccttcttcatctgccgtacaatctgaatcctcggatattcttcctgcaaagttactttgataaatggataagtcttatcatcctttaacatggtattatattttggtttgtgttctttaattaaattacattccaataccagtgcctctaactctgaatccgttacaatgtattcaaatcttgcaatctgttccaccatctgttctttctttatccccagatttcgactgctttgaaaatactgccgaacacgattttttaaactgattgcctttccaatatagataatcgtatcctctgcatcatgcataatataaacccctggttttcccgggagcttctttaattcctcttcaatacaaaacaatttttcccatcctttctccctgtattgaaagaagctatcacattcctgcgatagcttctctgtttctttaatcgtttctttaatcatttaattcgtttttagccagtactacttttggtgtttccttttcttccaccttattttctacgatacgcggtttttcttttggttcgctttctcccttgatttcacggaaaatcttcataaattcttttccggtaatcgtttctctttcaatcaagaattcggcaatcttatcaagcgcttctcggttttcgcttaaaagccgttttgcttcatcgtaggaatattttaacaatttcataacttcatggtcgatttctgttgcagtggaatctccacagttcatcacggctctgccatcgagatactggttctgcgtttccgcaagtcccatcagaccaaagcgttctgacataccatattgagtaatcatggctcttgccactttggttgcctgctcgatatcatttgctgcaccggttgtaacggtatcaaatacaatttcttctgctgcacgtccgccaagataaccaaccagcattgcctcgagttcttttttggtatttaaatatttctcttcttccggaacatgcattacatagccaagtgcgcccattgtacgcggtacaatcgtaatcttctgtaccggctcagaatctttctggagagcgctgaccagtgcatgtccgacttcatggtaagaaacgattcttctctcttccatgcttaagatacggtctttcttttctttaccaactaatacaacctcaacggcttctaataagtctttttgcgaaaccgcttttcttccattttttacagcaagaatggcagcttcattaatcatatttgcaaggtcagatccgactgctcctgaagttgcaagtgcaattccctctaaatcaacagtttcatctaaagatacatttttcgcatgtacttttaagatgctgacacgaccttttaaatccggacggtctacaataacacgtctgtcaaaacgtcccggacgaagcagtgcagggtctaagacttccggacggtttgtcgcagcaagaatcaaaagccccttagaagtatcaaatccatccatttctgctaacaactgatttaaagtctgttccctttcgtcattgcctccgaaacgggaatctcttgttttaccaatcgcatccacctcgtcgataaaaataatacaaggtgcatttttctttgcttcttcaaataaatcacgtactcgtgatgcaccgacaccgacaaacatttccacaaagtctgaaccagacaatgagaaaaacggtacgtgtgcttctccggcaactgcctttgcaagcagggttttaccggttcccggaggtcctaccagcagtgccccctttggaagttttgcaccaatctcggtatattttccgggattatgcaagaagtcaacaacttcctgcaaggattcttttgcttcatcctgaccggccacatctttaaatgtaactcctgtttctttttgtacataagcttttgccttactcttgccaacaccccccatcataccaccgcctttattcatacggcggaagaataatgaaatcagtgcaaacattagtacaaccggcacaacaaaacttaaaattgcatataagagttctcctgccatgtttggtttttcacgtttgaactctacatttgcctcatcaagtcgttttgtcaactcattttcatcttccgtggcaataacggtttttgtgccattccctaatttcccactgtttttcaacgttactttcaaatcatcagaatttatcactacactttctacctgacccttatcaagcagttggataaactcactataggaaatttcgctggatacattacttgtcattctggacagcatattcattccaaacagactgaccataatacagattaaaagtaccagaagggattgtttattcttaggtcccttattattattcgggtcctgattgcggttttgattttgatccatcttattcctcctcattctgtcctttctattatacgaatagcttgttaaaaaatcaattaaaaaactcgcttcaaatctaaaactttcatgaatttatttgttattctgccaaaagtttcttttttttgtttcccctactagaattttgcctgctctttgtagtataataaattttgtatgagtaaaaacagagtaaaaagaaaggcataaagaaaatgaagataggatttgataacgaaaaatatttatctatgcagtctgaacacattcgtgaacgcatcaaccagtttgacaacaaactgtatcttgaatttggcggaaagctttttgatgactatcatgcatcaagagttcttccgggatttgcaccggacagcaaactgcgcatgttaatgcagttagccgaccatgcagaaattgtcattgtaatcagtgctggagatattgaaaaaaataaagttcgtggtgaccttggtattacttatgatgctgatgtactgcgtcttagagaagtttttcaggagcgtggactttatgtcggaagcgttgcaatcacacagttttccggtcagccggctgctattaatttcaaaaagaaactggaaaaactcggcatcaaagtatatattctctactccattgatggctatccaagcaatattccgcttattgttagcgatgaaggttatggaaaaaatgattacatcgaaacaacaagaccacttgtagtcatcaccgcacctggacctggaagtggaaagatggcaacctgcctctcccagctctaccatgaacataaacgtggagttcatgcaggatatgccaaattcgagactttcccaatttggaatattccgttgaaacatcctgtcaatttagcttatgaagctgcaactgccgacttaaacgatgtcaatatgattgacccgttccacttagaagcttacggtgaaacaacagtaaactacaaccgtgacgttgaaattttccctgttcttcgtgcaatttttgaccgtattttcggaaaatgcccatatcagtccccaactgacatgggggtcaacatggccggaaactgtattattgatgacgaagcctgctgcgaagcatcccgtcaggaaattatccgtcgttactatcaggcagtagacggacttgcagatgagactaagacccaggacgaagtgtttaaaattgagctgttaatgaaacaggcaaatatctccttagaagatagaaaagtaacggttgccgcaaaaaaacgtgccgaagaaaccggagcacctgctgctgcagtcgaattagacgatggacgcatcattacaggaaaaacttctgatttacttggtgctgcttctgcgctcttattaaatgcgttaaaagaccttgcagggcttcctcacaatcttcatgtaatttctccggcttctattgagccaatccagaaattaaaaacatcctatcttggcagcaaaaatcctcgtcttcatacagatgaaattttaattgcactttcaagttctgccgcaaccagcgacgctgcaagacttgcattagaacagcttccaaaattaaaaggatgccaggttcattcttctgttatgctttcttcaactgataaaaaaacattccagaaattaaaaatgcaggtaacctgcgaaccggtttttgaacgtaaaaaactatattaagatttcaaaaaggggcagacacagctaatccgctgtatctgcccctttcctttttgccaattttaccaatcaaaattatcaattaatcatcataaccattcgggttattagactgccatctccaggaatcttcacacatttctttgattccatattctgcggtccatccaagttcttcttttgctttttctgcacttgaatagcaggttgcaatatctccaggacgacgtgctttaataacataaggaatttttacacctgttgcagcttcaaagttctttacgatatcaagtacgctgtaaccttttccagttcctaagttataaatcttaagacctgctttttcttcaattttcttaagtgcttttacatgtccttttgcaaggtctaccacatggatgtaatcacgtactcctgttccatccggtgtatcgtaatcatttccgaatacacccagctcttttaattttcctactgctacttgagtgatgtatggcattaagttattcggaataccgtttggattttctccgattgttccgctcttatgtgctccgattggattgaaataacgaagcagtactacgttccattcagggtctgctttctgaatatcggttaaaatctgttccagcatagattttgtccatccataaggattggtacactgtcctttcgggcattcttctgtaattggaacaaatgcaggatctccatatactgttgcggaagaagagaaaataatattttttactccatgttttctcattacatcaactaaagttaaagtacctgcaatgttattttcataatattcccacggttttgccacggattcaccaactgcttttaaacctgcaaaatgaatacaggaatcgatggattctttctcaaatacttcatttaatgcatctctgtcaagaatatctgctttatagaaagtcaccggttttcctgtgattttttctactctctccagtgatttttcactcgcattacttaagttatctaaaacaaccacatcatagcctgcgctctgcagttctactacggtatggcttccaatatatcctgctccacctgttactaaaattgccatttgttgttcctccttttaaaacctctaagttttctgtttagaaacatcttttatgttctatattactttaccatttttttttgaaaaagaaaagccttaatttatttttcccataaatattccggatacagaccttctgctttcatacgtttaattgcagccacaactaccggtttgtcttctttataggttacaccataccatttatctgtagattttaaaacctgaacagtcgctttttcttctgccagcagttctccgactacagaaggcaggaagtattcacattttaacggattcttttccagattttcttctaagaatttcggaaaacgattttttaactctgtcagcatactcggtgtaaatccccacatattcatggatacaatactgtcatttggaagtgctgtccatgtttcgccatcatcttccgtatattctgcctgttccccatgtttttcaatacgggttctctcacagattcctaccagatgaccgttttcatccgtctcgcagactcctcttgccacatgtccgttttcggtcaatgtattttccagcacatagccaaccatagtatagcggtatttttcatcatcttcgtgtgtggttaagaaatcatagattacctggaatgcatgagaaccatagtagtcatctgcattgataactgcaaacggagcatccacttcgttaatacagcttaagatagcatgacctgttccaaatggtttgacacgtccttcaggaacggtaaatccttccggaatgttttccagtttctgatagacataacttacatcaatcactttgcttaagcgatcaccgattgctgctttaaagtctttttcattttcctcttttataataaatactacttttttaaatcctgcttttactgcgtcgtaaatggaaaagtccataatgatatgaccctgttcatctaccgggtcaatctgttttaatcctccgtagcggcttcccattcctgctgccataacgaccaatatcggatttttcataatctatttcctccttataaaatcatcagatttctttctaattttaccacataactatctgtatcgtaaagctgacttgaatttctcaacgaaaaaagagccatttcttctaatttcgattcttatttattttatatttttatcttatattaattaaagcagacttaaaagctgtccactgaaattaattacaaaatgtaaatacatcgatgctttcaaagttccataacgttttactacagcaccaagtaccatccccaataaaaacgcatagattccctgtaccagattcagatgaatcataccaaaataaaatgcctgaatgatatttgccacccagaatggaaactcttttcttaaaatcacaaggcagagccccctcataagcatttcctctacaatcggtgccgtaatcaccacataaaatacagaaaagagactcggatttccacttcccagactctccattacttttgtataattctgcatcaaatccggtcgaacgatatacacaagattcaaaagaaaactgattgcaaactggacaaaaattcctaatactgcaagttttaaaagaaccgacagattcagattcttttgttgattccagaccggatattttccgcctgcccgcatccgtttataccagaataccccaatcacaaaaaatataaggtatgccagaatactaatcaggtacagcccttcctgttctaaaaatccagaaagccagttaccaaatactgttcctgacaccgcagtcattccaatcattcctgtaaaagtacagccacatgaaacaagaatttctattataaaataaactgcaatcggtgtcagacttaataataatgtctttatctttctgctcataattctttaaagtgaaactggctgtttccctgtgcataatctgccacaatctgtccctgtccgtataatttatatttataagtaacaagcccctccagtccaaccggacctcttgcgtgaatctttcctgtactgattcctacttctgctccaaatccataacggaatccgtccgcaaatcgggtagaacagttttgataaacccctgcggaatccactaactgcataaatttttctgcaatttcctgattttctgtaagaatacaatccgtatgatgagaaccataatgattgatatgtgcaatcgcttcttcttcgtcttctaccagtttaactgaaatcaccaaatccagatattctgtatgaaattcttcttctcccatcacttcacaagaaatgatttcactaacttcttttgttccacgaattttcactcctgcctcttttaaagcagtttcaagttccggtaaaaattcttttgcaatttctctgtgaaccaataaggtttccaccgcattacaggctgccgtatattgagtctttgcatccacaatcaccggaatggctttctttttgtcatactctttgtctacataaatatggcagacgccgtctgcatgtcccataaccggaatctttgtatgattcataatatactgaacaaaagaatttgaacctcttggaatcaataaatcgaccgattcatgacaggataagagttcatcaatctcattatgttgttctgcctgaagcatacagccttccggcactccgaccgaagttgctgccttataaataatatcaaacaaaatcttattggttcttgcagtttcttttccaccttttaagatagcgcagtttccgctttttaagcaaagcgaagaaatctgaaccagcgcatccggtcttgcctcaaagataattccaatcacgccaatcggacaactcacacgataaagatttagtccatcatctaactgtcgtgccagctgtacttttccaagcggatccggcagtttgattaattcgctgattccgtttactacatccatcagtttgtgttcatcaaatttcaggcgttttttcaccgccggtgcgattcccattttttctgcagcttccatgtcttttttattttccagaaaaattgcttccctatttaaaaggagagcctcctttaccttttcaagtgccagatttctctgcgcttctgaaagtcccgccagctttgggctgtcctgcttcatcttttttgttgcttctttcatattcatactgccgattcctcctgattttcggggataattttacttcttaccgctcattatagctcgaatttcctttgcttgcaatcccaattggaacaaagtacatcatgtacccaattttaccaaatgaaaatctaaattttttcataatccttatttaaaaatagacatagcagtgctataatgttcacacggcatatcatagtgatatgcaatttttcatattctttaattggaggattttatgaacattattatagtagggtgtggaaaagtcggacgcacccttgccgaacaactcagcaatgaaaagcataatatcgtcattgttgatattattgagaaaaaaattcaagacactaccgaagacatcgatattatgggatttctcggaaatgcatcaagtatcaatacccttctcgatgccggaattgaaacagcagaccttttaattgccgtgaccggttctgacgaactaaacctgctttgctgcctgatcgcaaaaaaggtaagcaaatgccacactatcgcaagagtgcgtaatccggtctacagcaaagaacttggatttctcaagcagagtctcggaatttccatgattattaatccggaacatgctgctgcgattgaaattgcacgtatcttacgttttccatccgcaattaaaatcgacacctttgccaaaggccgtgtggaattattaaaatttaaaattaagccggaatttaaattaaacaatatgtccgttatggaatttggtgaacgctataaaaacctgattctgattggtgcagtcgaacgtggagaagaagtcagtattccatccggtaattttattttaaaggataatgatactgtgtctgtcatcgcttcaccaatcaactccgctttgttctttaaaaaaatcggaatccatacacatcaggtaaaaagcaccatgattgtaggcggtggtactctttcttattatcttgccaagattctcttaagtatgaagattcgtgttttaattgtggaatccaacgctgcccgctgtgaacagttaagtgaattattaccggacgctaccattatccacggagacggaaccgataaaaatctgctcttagaagaaggattgacccgtgtggaatcttttgttactttaactaatctggatgaagaaaacatcctgctttctttatttgccaagaaaaacagtaatgcaaaattggtttcaaaagtaaaccggattgcgtttgatgatatcattgaaggtcttgatatcggaagtgtgatttatccaaaatacattactgccgattatattcttcaatatgtccgtgccatgcagaacagtatcggaagcaatgtggaaaccctttatcagattcttgataataaagcagaagctcttgaattttccatccacgatgactgtccgtttttaaatatcccgctggctgacttagatatccgcgacaacctcttagttgcctgcattaaccgaaatggtgtcatcctgattccaagaggtcaggactcgattcaggcaaaagatacagtcgttgttgtcactacaataaaaggactcaatgatattcaggatatcctgaaaaaatagtttactttattactaaaaggaaaatcaaattatgaattattcgattattgcttatatcattggatggattttaaactttgaagctttatttatggcacttccctgtataactgcaattttctaccatgaacattccggctgggcatttttcttatctgctatgttctgcctcttaattggaattccactggtacagaaaaagacaaaaaataaaatcttttataccagagagggctgtgttacagttgcactaagctggattatccttagtattatgggtgcacttccatttttaattggcggtgttatttcaaatccaattgatgccgtatttgaaaccgtctccggttttacgactaccggtgcaagtattcttctggatgtagaatctcttccaaagtgcatgttaatgtggcgaagttttactcactggattggcggtatgggtgttctggtctttattctctgcctgcttccattaacaggaggtgacggcggttatcatgtcaacctgatgaaagccgaaagccctggaccatctgtcagtaaactcgttcctcaggttcagtctaccgccaaaattttatattcgatttatctgactttaaccgttatcgaatttgtattacttttatttggtaaaatgtctgtttttgatgcacttaccacctcatttggtacagccggaaccggtgggtttggcattaaaaatgacagtatagcgggttactcgccttatattcaatatgtagttacgatatttatgattttatttggaattaatttcagtgcttatttcctgcttttaagcaagaaactcagacaggcaatccatatggaagaagtacgctggtatctgattatcatctttgcttccattgtctttatttcttttaatgcaagagcaatgttttctactttagaagaaaccataagacatgtctcatttcaggtagcttcggttattacgacaactggttttgctacaacggactttgatttgtggccggaattttcacgtacgattctggttattttaatgtttattggcgcttgtgccggaagtaccggtggtggaatcaaggtttccagatttattttattaatcaagaccatgaaaaaagaacttcacacttacctgcatccaagaagtgtaagaaaaattcagatggatggcaaagtggtagaacacaatgtccttcgttctacgaatgtttatatgattgcctatattctgatttttgtggcctcggttttactaatcagccttgataactttgaccttaccacaaactttacagcagtttctgcaaccttaaataatatcggtccggggcttgaactggttggaccgacccagaactttagcctcttttccaatggaagcaagctgattttgatttttgatatgcttgcgggacgtctggaattgttcccacttttacttttatttgtaagagattcctggagaagattttaaccgaatgaaagaagtctccccccactgagataccaaaaagagcagatgtccatcacttctgatgaacatctgctctttttaatatcaatataatctttgttcctctttccggctcactgtcaatttcaatccttgcatcatggagaattgccccatgttttacaatcgaaagtccaagtcctgtgcctccggtcttttttgaatgactcttatctacacgatagaaccgctcaaaaatacgctcctgttcttcttttttaattccaattccattatcttcaatagaaatttgcacctgattttgattcttcttaacctttacttttacataaccaccttcatgattatatttaatcgcattatctgccacattatacatcatttcatataagatatggcgcactccatttaccattatctgtttttctgcttccacagacagcttaatctttcgtttttctgcttccacaagcaaagtcgtgccgatttcttctgccagttcactgacatctaccaattcaaacggcatgctgattccctcatccaattttgaaatctcaataatgtcctgtaccagattcgtcagtctgcttgcctcttcatagattcgtccggcaaaatcaggcactttatccggcggaaccatgttatttttcataatctccgcataaccggaaattgacattaacggtgtttttaattcatgagaaacatttgctgaaaattctttgcgaacttcttctgctttttttagttcttccaactgttgtttcaactgatgattctggtcgtcaattcttaccagcagtggtctcagttcttcatatgctacactggaaagtggttcttctaaatccaactggttaatcggtttaattaattttgaagtctgtttttcaactaataagaaggcaaatgccaaaattacaatcagcaggattcccatcaaaaaaagtccggaaaacatggcttgaaatacactgtctgtcgtttttgccacacgcaccagccgtccatcatctaatctcagggcataataaaaggtcttttttgataaagtttccgagaaacgaacggtttctccttccccttcttccatcgcctgttttacttccggacggtccttatgatttcccattgttgcagaatcttcttccgaatcatactgaacagttccgtcttcatttaatatggtaattctgctggttgtaagtgttcctgcctgttcttcccatccactgtctgtcgtctgctctaaaagcagacggacgtactgcgcttcatttcgtacgtcctgttccatccattcatttgtttttacatacatgatgacgcttgctgacacgaaggtcagcaccatcgagagaataatcataaaccctacataatttaagattctttttctcattttctgtctccaattcgatatcctacccctcggatagtctcaatcaatgctcctgattcttcgagtttttgtctcaatgtccgaatgtgtacatctactgttcgagtttctccatcaaaatcatacccccagatatgttccagcagtttatcacgagttaacacaattccctgattttccatcagataacggagcatttcaaattctttgtatgtcagctccacctgacgttctccatctaatacccggtggcgttccacatcaattgaaagatttccacagcttaaaagtgtatctttcatctgttttttgctccttctaagcactgcttttactctggagataaactccatcattccaaatggctttgtaatataatcgtctgctccactatcgagtccacgcactttatcatactctgcttctttcgcagtcaccataatcaccggaatatctctggtcttcggatctttttttaacttttcaagaatgctgtatccatcctgacccggaagcatgatatccagcagaatcaaatccggcaattctttttccagacatcggaataattcttttccttcctgaatccctattgcttcaaatcctgttgtttctaatgtatatactaacaactcacgaatatttctttcatcttctacacaataaatcatacttccacctcttctggtttttctctaccagaaaagtatacttaattttttacggaaatacaagatgggagcgcatagcgtgcccgtgcaactcgggtaacactttgaaattctacactgcttttcttcattttttccaggtatcggtgtgtatcaaaggcatcctcctgtacctgacagatacagactgccacattcgaacaatggtctgccactctctcaagacttgctgtaatatctgaaagtacaaacccctgctcaatcgtacagtttccatttctaagacgtctgacatgacggttctttaattcaatctttaattcgtcaatgacttcttcaatcggctctacgcttcttgcaatactttcatcttttgtttcaaatccttttacggcagcctcaaccacatcttctactgcttttgtaattacttttaactccgcaagtgcttcatccgagaattttagatttttctcatacagctcttttgccgagcgcatgatgctgactgcatggtcggaaattcgttcgaaatcaccgatgcagtgtaacatgatcgataagtcatggctatcctttacatttaaatctttctgactcaattttaccagataagttccaagtccatcctcatagcggtccacctgctcttcttccgctaaaacctgttctgctttttccgaatcataatgttcgataagcccaattgctgtattgattgcatcttttactttatttgccatttcaactgcaactcttcgactttgttctactgctaaagccggtttatctaagaaacggctgtccaaaagttccattccggttgcttctgtttctttcttatcttcctctttgtcacgaatcgtaagaattgcaagtttttcaagtacttttgaaaatggaagtaacaaaagggttgcaaatatattaaaagtcgtatgcacaactgcgattcctgctgcatttgctgcctgattcataaacggaaactgtacaactgcattgattgcataaaacagtaccataaagacaactgttccaataatattaaaataaagatgtaccattgctgcacgttttgcatttttctttgcaccaattgcagataataatgcagtaatacaagtaccaatgttctgacccatgataatcggaatggccgcactgtaaccgactgctcccgttacgcaaagtgcctgtaaaattccgacagatgcagaagaactctgaatcactgcggttaaaatcatacctgccagaagacctaaaatcggattggaaaattttgttaaaattccggtaaattccggtacatcagcaagtggttttactgcgccgctcatactttccataccaaacattaatactgcaaatccaatgaaaatcgttccaatatcttttttcttttcactttttgcaaacattaaaaatgcaacaccaattaatgccagtaccggtgagaatgtagtcggcttaaataactggataaaaaagttatcactctgaataccagataagcttaaaatccaggaggtaatcgtagtaccgatatttgctcccatgataacgcctactgcctgagataatttcataattccagagtttacaaaacctacaaccataactgttgtagccgatgacgattggataactgcggttaccgcagctcctaaaccaactgccttaagtggattcgaggtaagtgtctctaagattttttccatcttaccgcccgaaaccttttccagaccgtcccccatcacattcattccatataaaaacagggcaagtcctccaagtaaagtcaaaatactaaagaaatccataatttccttcctttctctttcatttgaccttattctatctatcttatgttaaattctttcgagacaaatgtaaaatctatgtaaaataataatagatgaagccatcgcacaaaagtaccctgacttcatctattgtttaaattgcctgaatgagttctgtaatcaattccttaaatcttacagacactttgtcagcagtctcctgtacttctttatgagaaagagcctgtttgctcatccctgctgccaaatttgtaatgcaggaaattccgcatacttccattccaagatgccttgctgccattgcttcacatgctgtactcattccagccgcatctgctccccagcttcttgccatccggatttccgccggtgtctcataattcggtccggtaaactgcacataaaccccttcctgaatcggaatctccagcttcttagcacaaaagattgctatttcacgcatcctttcgctgtatacttcactcatatccggaaaacgcggtcctaattcttctatattctctccaatcaacggacttggaactgctgttgtgatatggtcttttaaaagcataaaatcacctgggcggtaatcaaaattaattccccccgctgcattcgtgagaatcagcttctttgctcctaaaagtcccatcagacgaatgggcaaaaccacatcactcatcggatatccttcatagtaatgcactcttccctgcatgatgacaaccggaacgcttccaatatagccaaatacaaatcttcccttgtgtccggctactgtagataccggaaatccctcaaggtctttgtaatccacagtttctttcacttcaatgtgttctgcataatctccaagtcccgagccaagcaccagtgccacttccggtttaaaatctgtttttttcttcagactttccagacacgcaaataatttttcctttacctgatccatagattgccctccaatcatattatctaccctaaaaactacgaattgcgtcctctccatccgcttcctgaatcgagcgaatttctaccggataactcacagaatcattgacctgtactaaaacagtctccccggctttatgtccaaggattgcttttccaagcggagattctatgctgattcggttatccagagaatttccacgaatcgatgttaccaatttataagtctctgtctcatcatcctccgggaaatagatttctaccaaatcatttaatcctgcttcgtctttttttgttgtatctgttacaatctttgcagtttttaacattctttccaaatatcgaatacggctctcatttttattcttatctttttttgccgcataatactcaaagttttcgcttaaatccccttgtgctcttgcttcttttactgcctcaattgcatttttacgcacgactaattttcggtagtcaatttcttcctgtattttttttacatcactttccgtcaattgttcctgcataatcttcacctcttctatgatatcttagaatccacctgtgccagaaatcctctgcgtgccagttctgcttcaatatcatctaatgtgctttcactgtccgctaagattgtatgataatgatatcccgaagtaatatttttaagcgggcttgactgcccactttcaatttttgccacaaaatcgccaatcttctttcttgaatcaagtccaagttctgcagacagacaaccataaatcttatgattgataaatacatccgctacttttccgccacaatctacaatcagattcagctcctcctgaatttctttatccgtatggcagacataaatgacacgtgacgcaaacaccggtgtctgcagcacatatcctctatgtgttgaaagaatatcctgattttgtgcacgtaaaagtgcaacatcctgtacaattacctgacggctgacgtcaaattgttttgccagttccgtgccggaaacgggcttgggactctgcccgataaattttaagatttcttttcttctttcttcaccgttcatccttcacctcttccttcctgttacgtcttgcaacagaactctattgatttacaggatgaagatttttcatggaaatgtcaagtatcggtgcagaatgtgttaatgctccgcttgaaatataatccactccgacagaaaccagtcttgacacattttcttttgtgacattaccggaacactctgtctgtgctcgtccgtcgataattttgattgcctctctcatttcatccggtgtcatattatctaacatgataatgtctgcacctgcttccactgcttcttttaccatttcaagattttctacttcgatttcaattttacggacaaacggagcatattctttcgccatctcaattgcttttgcaacacttccggctgctccgatatggttatcttttaataaaataccatcggataagttatatctgtgattacatccaccgcctactttgaccgcatatttttcaaatacacgcatatttggtgtcgtctttctggtatcaagcagtctggtcttactaccttctaacaaatcgacaatgcttcttgtataagttgcaattccactcatacgctgtaagtaatttaacgcaactctctctccggaaagcagaacgcgaatatctccacgaaccacacccatcagctgtttattttttacgacatcaccgtcttttacataaaattcaacttcagttttttcatctaataattcaaatactcttttataaacttcaagacctgcaatgacaccgtcctgtttacagattaactgaacttctccagggcaggcttctctcatcactgcatttgttgtaatgtcctcacttgtgatatcttcttttaatgcctccataatcaaatggtctgcatttaatttcattgtaatctggttcatactgcttcttcccttaccctttcaatttcttttcttacgctttctgcatataatttctgaagttcttcttttcctaagaatttcgttgcgtctgcttttttaagcagtgcattttgtacattttcttcttcggcagtttcttttgtttctaaaatctttgtaatctgtcctgcggcacgttttgcaaataccagactttctaataaagagttacttgccagacgatttgctccgtgaactccattacagcttgtctcaccggatgcatacagacatttcatggttgtgcggctgtatttatctacttttactccacccatgaaataatgctgtgccggaacaaccggaatacattcttttgtcacatcaaagccttcttccagacatttctgataaatattcggaaaatgtgttttaatctgtgcttctccgagtggacgcatatcaagccatacataaggtttatggtcaatctccatctgttttcttatctcagctgtcatcaagtcccttggcagaacttcatttgcaaaacgttccatttttgcattgtataattttgctccctctccacgcacggattcagaaattaaaaatcttcttcctggttttggagaatacaaagtcgtcggatgaatctgaacataatccggatgttccagttcaattccatgttttaaggcaattgccaatgcatctccggttaaatgtgggaagttcgtagaatgttcatataatcctccgattccaccacaagcccatacaaccgctcttgcagtcactgcaaacaatgttttgtccgcgcttcttgccacgattccatagcactggtttttctcttccagtatatcaatcattgtggtctgtgtcaaaagttctacattagaaagtttctgtacacaggcaagcagcttacttgtaatttcttttcctgtcacatcctgatgatataaaattcttgatttagaatgtgcgccttctcttgtataagccagctctccgttttcttttttatggaattctactccgcagtcgatcagttcgttaatcacttctcttgaagaacgaatcataatatccacggattctctgcggttttcataatgaccggctttcaacgtatcttccataaaagaatcataatcctcttcatttcgctccacacagattccgccctgtgctaaaaaagaatcactgttttcaagttcatctttcgtaatcataagaatttttttgtcttttggtaaatgtaaagcggcaaataatcctgacacgcccgttcctacaattaccacatctgcttttacgtgtttcatttatttccttctcctatcccttcacattaaaattgctcagtttttgaaattatacatcttttctttacatctgacaagacagatgtaaacttgtactaaaacaagtacaaaaaaagaatcccagccaagggattctcttgtcttttttatttctgaagttttttctttcccaaccgtacttcttccatcaaatctgccatttcttcatctaaatggtcaaacagataatttttctctttcgatgtctttttttgcactttctttgaaatctctgcttctactgcttctacttcttctaaaagatttgcagcagaaagccggtttccaccctgccctaagataatcacctgttctaaggcatccgaagtggcaactgtaacctgatattttctgccaatttcatgtactgttttttcaatatactggtcggcggtttctgcttctttggtatagaccacataaatattgtggtatttcattacacttcctggattgcctttcactttataagcatcaaagaccagaatcaaagtcatttttttatacccctgataattacttaaacggtccatcagcttatttcttgcactttcaatattgatttttgaaagttcatttagatcttcccatgcaaatataatattataaccatccacaagcagatattcttttatcggttctcgttttttctcttttctggtattttctgtctcactgcttctgacacttggatttctgtttggatttctttttgaaacccgctcccagccctgtcgttctctttttactgcaccataagtacgctcaaagatggctcttagttcttcttcattttgaactccttcttttagataagcttctgcttcctggggggttctttttggcattggaatttcttcttctacctgtttttgcatcggggtctgaagttccagatgcatatagtcttctacttcataccacggcacaataaatcctgccccatgtgcacaaaagacagaaccggttggattttccaaatcactttcggaatcgtagttcatctcttcaatcacttcatccgcattatggcacggcatatagcctttcaaggtacaaaacagtctgccgtgcccacttgtataagccatcacttctttttgataatcgcgcatcaaagaaaccggtgcaaaaccagtcactacggaatattctccttcgctgtctgaaagctgaaattccccatacattttctggatatccgccatcgctcttcccactttatctgccggcagctccagtcggaattcatagaccggctctaataaaacactctttgctttttttagtccctgacgcagagcacgatacgttgcttgtctgaaatccccaccctcggtatgttttaaatgtgcccgcccgcttaccagcgtaaccttcatatctgtaatttccgaaccggttaaaactcctttatgcattcgttcttctaagtgcgtcatcaccagcctctgccagttcctgtctaataaatcttcactgcagtctgcaaagaaatgaagtcctgtgcctctttccgccggttctaattttaaatgtacctcggcataatgacgaagcggttcaaaatgtccgactccctcgacgcaatcttcaatcgtctctttatagacgatttttccactaccaaactccacttctgtctgatagcgttcccaaatcatgcgctttaagatttcaatctgtacttcacccataacctgtgcatggatttcctgtaatctctcatcccacacaatatgaagctgcggttcttcttcttccagttcttttagtttgattaacatactgtgcacattacagtcttccggcagttcgattttataggttaagaccggctctaaaaccggtaagaacgtatgggcttcgattccaagcccctgtccgcagtaagtatgggaaagtcccgccaccgcacagacacttccggctttggcttcttttactgcctcaaaagaatttccggaataaatccgaatctgttctgctttttcttcccagagttcttcttttccctctcctgcttctttttcatttgataacagcatttttacttttaaacttccgccggttatttttaaataagttaatcggtttccctgtgcatctcttgcaatcttaaagacccttgcaccaaattcttcaggataggcacatttttttgtaaaagtttcgattccttttaaaaattcttcgacaccctgaatctttaaagccgaaccaaaataacaaggaaagacttttctctttgctattaagtttatgatttcttctttctggatttctccgctttccagataatgttccaatactgcctcatcacagactgcaagattttcctttgcctcttctgtttcaagtccggcactgaaattaatgcatttctcatctaatcgttttgtcagttcttccatcagtgcattttcattggtatccggctgatccattttattgataaataaaaagaccggtatctcatactgttttaaaaggcgccataaggtctgtacatgtccctgtactccatctgctccactgataaccaaaatggcataatccaatacctgaagggttcgttccatctcagccgaaaaatccacatgtcccggagtatcaagcagggtaacctcccgctctcctaatctaaattccgcctgtttggaaaaaatagtaattccacgctccctctctaattcataagtatccaaaaatgcatcctgatgatccacacgccccagtttccgaatgctgcctgtcagatacaaaatgctttctgcaagcgttgtttttccggcatcgacatgtgccagaatcccgattgtcagtttgtttgtattctctaaatccatctatattataaacctacactttctgcatttgacttttttgtattatatcaaaaagaacgtgaaaaagcaaagcagggacaaaagccctttgataagcttctgcccctattttttgtttcattagtcaagcggatattcgcaatccgctttcgctacttgctcataaccaaatagctgctacgcagcttatcagaaggggcttgccccctcctgatacaagcaagtccccacccctgcttattgctttttgcaattaaagcaggggacttccttgatttggttaaatccttttaaaagagttttatttgctcttttttgttttgctccaaactccggagttatctaagtaataatcgccaacccatacattactcttcatagaaccatcctgttctcctccaaagtaataccatttgccgttgattttctgccagcctgttttcattgcgccatcgtttgcgcttccaaggtaataccatttaccccagattttctgccagccagtcttcattgctccgtcatctgcaccaccaaagaagtaccatttaccgttaatctgctgccagtaagttttcatggaaccatcttcagcagagccaagataataccatttaccgtaaacctgctgccatcctgtcttcattgcgccatcgttttcacttccgagataataccatttaccccagattttctgccagccggtcttcattgcgccatctgatgcatttccgaggaaataccatttgccccagattttctgccagtaagttctcatgacaccatcgtttccaaagaaataccatttaccgttaatctgctgccagtaagtcttcattgctccgtcgttttcctctccgaagtaatatttcttaccgtcgatttcctgccatcctgttttctttgtaccgtcttcgccataatagtatttctgaccattgattacctgccatcctgtcttggacagtaatgcctccattgctttttgcaggttttcttctgcagcttcgatttctgcctgtgttgcatcgtctaaatcaagcactgcttttgcagcttctaatgcctgttcaaaattatcccaggtagatgccacatagtcgtctttgtttaattcttctgctttctctactaatgctttgagttcttcaacagatggtttttcttctccaccatctactttttcaagctgtgtcattgcactttccagtccgcttactgcttcgtctacttcttcctgtgttgcagtttcatttcctgctacgctctgtgctttttcgagtgcttctgcaaaaattctccaggtttcctctgtgtagtctgctcttgttaatgcttctgctttttcaagtgcagattccagtttgctcttatctgccggattttccggttcggttggttttgcaaccagatttgccattgccgcatttaataatgcagtctggttatctacttcttcctgtgctgcattttcatctgcataaacttcttttgcagattttaatacacgttcaaagctttcaaaactttcttctgtgtaatcctcttttacttttttgtctgcctcttcaattgctgcctgtaatgcacctttgtttacttcctgtttttcaacaagattctgcattgcttctgcaagtgcagtttttactgcatcgacttctgcctgtgttgcattttcattttctgctgctttttcagctgtttctaatgcagttttgaatgtttcaaagctttctgttgtatagtctgcttcattcttttcttttgcacgttcgattaatgcatttaattctgtcttgtctgctttttcttttaatgcttccatagcagtttcaagtgcagctactgccgcatcgacttctgcctgcgttgcatcttcttttgcgtaaacttcttttgctgcatcaaatgcttctttaaatgcgttccagctctcttctgtatacgcactttcttctttctgttctgcaagaaccaaagctgcggataatgcttctttatttacagtctccggttcttctacagcataaacaccgtttactttccattcgatgataccggttcctcttgaagcatcttctgttgcgccttcacgaagctgtggtgctacagtcaggcgtactgctgttgttttaagctttccaagtgcaatggtattgtatttatctgctgcacactctaagttctgtgcatctgcaacttttacccagttaccattttcatctaaatattctacgcctgcggactgtggcaggaagttcccaccgccatcctggaagtaatacacatccatgctttcgatttcaactgctttttcccatgtgtaggaaacccatccatctataacacttccgtcttctgcatagcgattatgccagttgtgccatacaccatttgaggtatctgcggaatttgccggttctttttcgttatttaagcttgcaagaccaccaagatcatcaattctgccgtctaaaccgtcatagttgcaaagtccgtctgtttttgcatctggtgcaagattttttacctctgtatccggtttggataattcaaggtttgccattgcttctttcagattggaaagtgcttcttcaatctgttcttttgttgctatttctgattctgctacttcttttgctgtatctaacgctgtcttaaatgcgttccaggactcttctgtataaacttcctgctgtttggtttccgcttcttgaatcatttctgttaaagcagtcttgtctggagtttctgtaacttcttccagattgttctgtgctttaatcagggctgaaagtgcagtttctgcttctttcttacttgcctgtgcatcagcttcaattgcttttgcgtttgcgagtgcttttgtaaatgcagtccagctttcttctgtataagagcctgcttctaatttttcagcttctttgattgcctctgtcagctcgctcttatcaacaggcgctaacgtaccatatactttccactctacaacgcctacacctgtattatcttctgcctgtttatttaaggtgacacgaagagcagttgttgttacttcatcaaatgttgttgcattaaatttgtcaatttctaagctgtaagcacttgcatttggaatttctttccagcttccatctgcatccagatattcatatacatacgaagtcggaagattgattccaccgttatcggtttctgaaccatcataccagaagtaaatatcactgccttttaaggttacttctgaaccccaggtataagtaagagtttcgtatttacttgtgttgccccatgttccgtatcttgcgattcccggattataagatttttccggaacaagaccatcgttgataccagaaagtttttcccagccggatacaaagcttgtagaagcagttgcgctaaatgcaaggtttccatcttttgccggaagagaagcaatgactctttcgagttttgctgctgctgcatctacttcatcctgtgttgcttctttgttgtcgtaaactgcctgtgcttcttcgattgctgcacttaaagtagcatctgcaccttcttcaaataaggaagtgtcaacagattttgctttatccagtgcagattttaataactgtttgtctgctgccatttcattcgaatagccataaactttccattcaatgacaccacagcctaatgtttttggtttcatccacatacggattgcagttgttgtaaccggagcaaatgtagtcttgttgtattgattgagtttcactccaaatccgtctccattttctacttctttccagtttccatctgcatcaaggtactgatagcttaccgatgccggtgcaaaatttccatcggtaaagtagtaagcatctgttcctgtaattgttacttcgttattccatgtgtactgaacccatgcatctcctgactgatttcctccctgccagttatgccatactccatgagaagtatctcttgaacttgccggttcataaccatcatttaatccggctacgccacctaaatcctgaggtgtatttacaattgcagttggtgtcgcaatcaaagcaatgttctgctcttttccttctactacctgtactttggtagataccggataatcaattgcttctaatttaccgtttgcttcaaattcaccacgttttgtatataaggatttttcaatgtcatcccatgtgatggattcatatttgcataagccgtttgagtattctacttttgctgtctttggcatatttggtgcaactccaacggaggtaatcaccggtgaaattacaacatttttaattgtagtttctgcttcagaaccatattctttctttaattcttctgcgcttaccgctttagaaagcatcttgaagttatcataggttccgtttaaccacggagaactttcagaactggcacgaccgataaagtttttctgtgtttttccaagtttatcaaaggaaaatcctgcatctttgatttgggcatacgcttctccgttgatatataaaactgcggtattgtcttttaaggttacttctacgttctgccaggaaccagaatttaaaagcacacctgcttttacagtttctgattcatttgtttcaagatttgtcactgtcatggacagttcgtttgcgctttcaaaagatacctggaatacatttccatccatatcgccaaattcaaacagtcttgttccatttgtctgcgtaccgtttaatttcacatccatggaaatggttgcttcttttgtgttctttgtcaagtcactggaaagtttgacataaccaccgatttctccgtccatggaaataccgtttccgccatcttttccttctgcaacttctacatttcctttttgctgtgcatcaataccggaaccgctgatatcttttactttcttatttgcagtgtccatattggcagcttcaaagtcatactgtgcaagtacttccggtaaatcagattccccttctaccgtaacttttacagtatcggatgcactgttactcttgcctttggctgttaattttaaggtgtattcaccagcttttggaaagcttacttttgtggaagttgcttctgtatttgaaaagtttacttctgcttcttccggagactcttctacactccattttacagccggttctgtatgtaaccatgcattgtctcttgcatttccgtgaagcatcactgtttcgtttacagttgttgttgcatcttttcccgcatcaactacaggtgttgtgttttctaataaatctccggctttgatttctacttttgcgctgtctcctgccggaagaggaagagcgactgttgttgtaccttcgcctgcgataaagcttcctgctacttctccatttaccagtacctgataatttcctgccggaatacctgtcaggtctaggttagattcatgttctacaccagttacatttacaatgttcatggaaattgtacttccatcttttgatacggttgcgctgtcatactggtcacgatacagttctaaagaaatcttattattaatcaggtttaatctgtggtaaacaccatctaacggaacaacactgtaagaagcaccattatctttcacttcacagccatatccaaataaaccgaataccgggtcgactgcaacatcagaggaagcgatacgaactgcaccaaaaagcgcaaggtcagcttcaccagacatctgtctccagccattatgaagttttccaccgccggttccaagtgcggtatcatttcccatttctgcctgataagtccaggaaacggttccgatgttttccggatcagcatcaatctgtcctgaattgattacggtaaagttcgcaagttttcctgcataattaattctctgtgcttcacccatttcgtcactgcttaaaccattgttttcaaaacgaagccagtcatccatacaatatcctgcaagagaagcagtatactggaagttgaaccagttttcaccacagattgtggttggatttccataatgataccagattggctgtacaccacggcaggctcttgtttttttattgacttttgacataacggaatcatttccaaacatttttgccagagtgtagattgcttcttcactggtattgtcataaggatattcagaaatatatggatatgggtcatttgcaaagttctggaattttttctccatgatacttgtcaagtttgctgcttcctcttcatatccacgttcctgtaatgcttcaatgatatccggtgtagtagattctcccatcagaccagttgcccagttataaccaacggttccttcattgtataacgcatccataatgttataacaacgaagcagataagtatctgcatcttcgatataatcaattaaatccggatactgtttggcaattttatacatagcaaaataggtattgtagatatgcggatatgcaaatccacggtaagttggtgtattgttcggttcttccattaagaagtcgtgaatcaggtaatcttcctgatgttctcccatcaggttctgccagattgctacatttaaatattcatctaacgcctgtacctgctcttttaccggattgtaggagttcatttctgcaagatattcgccatgaacatatccccagtcatcaccccagccccagtaaccatcaaaagagcctctcttggacttggtatccatcatccagtcatcaaatactttatcctgaatctcacctgctgcatcccactgtgttttcaataaaaaatcagagtgcgtggacaatgctgatttcaaatcatccatcatatagaactgcagcatggttgttttttcttcgccatcctgtttgtagtttacaatgatgtcattttgtcctaaatctccaaaagcaatttcataaatatgatactgctctccattgatttcttttgtttccagatattttgcataagtgttttcgtctgtgcgttcacacgcaagattattggaaacggtatttgtaccttgatgaagattattggtatgcggacagcgatattcaaaagaaatatcctttgcatctacctttgtatgaagatacatttttgccggcatatcttttgcaaatgtcatgcccggaactgcaactgcatcaatgattccctcatcataaagttcggttttcatctcagattcatctgctactcctgtaaaattaaaggaataggttttgctttctccggcttttaaagtcatgctggaactttccatgtaacctttatttccggattttgcatctttactgattgcatcagaatgaatatagaatacattcagaccgtttgcccagtctgcctgatccatacaccattctttttcttctgcacgtctctgtcccacctgccagtggtcctgatattcaaatccggcacctgtttctgtttccggtgtcattagcaggaaatgaccctgaccactcggtcttgttgcatatacataagaggagtcttttccaacaaagctatggtcgactgtgcaggcttcataagcttctccctgattcacccagatttcatgaaatgcaagcggaactccgaaatctccaaataccaaatcagaatcattggtattttctacagtgatatcccattttaactggtcatccactaaagaataggtttctaccagtttaaaatctttaatggcacgagtgccttctgcttttgaattatcataagtcacaataattttgttatcttttaattcaaccgttcttcctgcatcagaagaattggtaagagattcactccaggaatcttcaccatcctttttggtcttgaacatcaaatctccaagccattcatgtgcaccggtgtcctgttttggattatccttcacattcatgacatagtttgtgtcaaattcgtcccccacaattttcaatgacgtgatttctccatatttaccggtctctacgtcaaagtaatcattttttaaatgatatccattttctgtcttctccgcaatcattccatctgttgctgcaagtacatcaatactgcccagatatggaagataatttccaagcaccataatcgtggaaattgcgattgagagaatcgagcgcggtacttgtttcttatccataataattcctccttcttttttcactgcctctttcagatacgcacagccttttttgtatctcttttcgcagtttgtaaaacgttttactattttctttcttagtatactctcatcgaacaatttgttcaatgtttttgtgattatattttacattttggttgttatttctaatttctaatcttattttttataggattttactataaaataacgttttacttatttttcttttcaattcattgacttaaccgaaacttctccctataataaaagaaaaataccaaaaaactacactttactttaggaggtgatttttattgcaacaataaaagaaattgcaaaggcgtgtaatgtctcaatttctaccgtatcaaatattttaaatggaaaaaacaaagccagcgatgaagtgaaaaaactggtcttggaaactgcaaaagaaatgaactatgtgccaaactatatggcaaaaaacttaaaacagaaaaatacaaaaaccattggaattattgccgaggatctcactatcttccatactccatcgattatcgacggcatcagtgaatttatggaagaaagagggtacacactcttaatgggaaatatgcggctttatcagaaatatggtaatcttttttataaagaagaaaactatgactcgcttgtcgaagatgaagtacagcagatgcttgccaaacgggtggaaggaattatttacattgaaggacactaccatgtcatggataatatttccgaactcttctccgttccgcttgttgcagtttatggtcgggtaaaaaatcctgagattacttcgattatttacgatgatgagcaaggcggttatgaagcaacaaaagaactgcttgcaaatggacatagaaaacttgggcttatcaaaggaacagaagcaagctatcatacccttgaaagaaggaaaggatttttaagagcactttatgaatatcagattccgtttaatccatcgtgggaaatctgtggagactggaataggacagacggctatgaaggtgcaaaacgtctggtcaaagaaggcgtgaccggaatctttgccatgaatgacttaatggcagcaggcgtttatgattatgcggtcaagcataatctgacgatcggaaaagacctttccgtcatcggattcgataatcgggaaatctgtgccgcatttacccctgccttatctaccatggcacttcctttaagaaaaatgggaaccattgcggcagattatttaattcaaaaaatcgaacatcccgaaccatctcatcaggatgaatataaaataccatgtgaaatcttaaaaagaaaatcggtatgcagactttagtgctctgcataccgatttttctttttttaccaatacgaattcttatttccacaccgtatctttaattccaatatcggattctttaaacaccggattctttccggcttttttctgttcttcataatttttcagtgctttaattgcagtctttctaagcagcataatcgcaataatattaatgattgccataactcccattgtgatatcggcaatattccaaactacagaaaaatctgcctgtgccccaaagaaaattgctgcaacacaggtaaggcggaaaatatttaataaagctttactgtttttaataaataaaatattggattccgcataataataatttccaaccagactgctaaacgcaaaggcaaagatggagacagtaataaaatggattccccactgtccgatgttggtacggattgcttcctgtacaaatgggattccatctaatactccactttcaccctgtacacccgaaatcaaaagcatcatagctgtagtactgcagattaaaagtgtatcaatgaaaacagaaatcacctgcaccagaccctgtttaaccggatgatcaacatctgcagatgccgctgcatttggcgcactacccataccggcttcatttgaaaacagccctctcttgattccaatcatcaccgcacttccggcaaaccctccggcaaaagaacgggcactaaatgcattttcaaaaatcataccaaatacatgcggaatactgcttatatttgtcagcatggtataaattccaattaagatgtaaacaactgccataaccggaacaataaaagaagtaatcactccgattctatgggcaccgccccagataactgctgcaaatgcaacagccagtatgataccaactatcattggtacatgagtctgcgaataattcggaatataatattctaatgcggaagacatattaaaggactgaagtccgttaaatccataggcaaagcagataatcaatgcaatggaaaacaggattccaagccagcgtttttttaatgctttttccatgtaataagatggtccacctcgaaactgtccgttttcttctaccttataaatctgagccagcgtactctcaataaaagcagacgaactgccaatcactgccataacccacatccagaaaaccgctcccggtcctcctgctgcgattgcagttgcaattccggcaatgtttccggttcctactcttgaagcagtagaaatcatcaatgcctgaaaagaagaaactgatttttctccctcatttccggttttcttttccataatggattttaatccatctttcaataaacgaacctgaactccctttgtaaatacggtaaaaaatacaccagcacccacaagcagaatcagcagaatatacgtgtacatgaaatcgtttattcctgtcaaaatctgattcatacctctctcctttcaaaatgcgtatattctgccattataccgtattttaagtttgtgtcaagtcagtactgtaaagtgaaaatacattcctgcaaaatctctaacttcttctaataattacatattattacttcttctcccactctattagatgcatcagaattaatcatacgcctgacacttacaacatctattttataacctttatttccatacaactcgtttatcaaatctgtattatgatttgtaagcatacaataacatcctctcattgttaattcatcataaagttttgccagtctcttatgactttctatatcaaatccctcttttgtgtaggattcaaacgaagtaggattcaatggcgcataaggactgtccaaaaatacaaaatctccttttcgggcatccctgcaagcatcctcaaaatctccatcaataatagttatcccctgaagatacttagaaatttctataatagaatctccgttaacagaaaccctacggctattattgtacggaacattaaataatccttttccatttacccgatacaaaccattaaaacaatgtttattcagaaaaacgaataatgccgccaattctacatcatattctgatttcattaacttatcattataatgttccctaatggtataataatactgttttccatcttcccacatctcagaatctattttatttacttcacttaaaaactcttttggactatcgcaaattctttgatacgtattaatcaacgctttattaatatcattaattaatgcttttgaaggctgtgtcccaaaaaacacagcgccacctcccacaaacggttcaaaataatgattataattttcaggtattctctcctgaatcttgcttaataactgacgttttccacctgcccatttcacaaaaggtacaatctctgtttttctcattccacttcctcttctctatgtttatatttcttttcaattatacttgcaaatagccaaaagaacaaccacagtctttactccttacttttggaatacaaaaatatattcatggttaatgcccaaaaacagattgctatctatacaaaaaaatgatagattaattattaagaataatctatttttcaaaaataaataccaggaggttttacactatggctacttgtaacaaacaacatcgttatttagaaggatttaatgaacttccagaagctcaggataacagaaacggaggacgacatatctgtgcagcttgtgcttatgaagaaggcttaaaagatgctttaaatggtaatcttcctcaatctgacctttcccatctgcctgatagtcaggctggcactgtacgccataaaagtgcaattgccgcctataaccttggatatcaatatggtaaaaaaatcagtggttaataataatattgttaaatttttaaacttcttttttaaaaaacaaaaacccccgaaagcatagctttcgagggttgatattttctctgatagataaaaattatctcttgctgaactgaaattaacgttttggtaactgggaacgcttgattttactggattcttggaatatggtgttgcaaacacgttacaaacgcaggacttctcattacgcctcaccacacctctaaattatcaaagagggagatgattcaaagtaacaaatgtgcatcttcctctttttttctcgcaatatcattcaacttcgacaatttctaatcaattttgtttaaatattattcgttgctttgttatcattgttgtattcgaaaatatatatgtactcttctgatatatttacttctttctaaaaataatttgcaaatgtgatttcaaaatttttatctaaaaatttctataattgcatgttcaacttgatgttcttttattttatcaatgattatatgcatattttctatttctaattctatttttgtatccccatcctttggtaccataccaaattttcgaaatacaaatccagtaaatgtatcacaatcttttgctgtaaatgtaacacctatagcgtcttcaatatcacttaatcgtatatttcctttcacttcccacttgttatcacttattcttataataacagtttcttcttccgacgatattggttcaatatcatttaaatcgccaacaatttcttctaataaatcaaaaagagtcactattccaaccactccaccatattcatctaatacaatagccatagattgcttcgattgtttcatatttttaaaaagcacatctgcttttgtggtttccataacaaagtatggttcagaaattgcagaatctataaccatatccttacttttttcttttaatctaaaatagtcttttgcatttaaaataccaataacatgatctatcgaatctccacagacgggataaagggtatgtcgtgtattgtggatcgtttcatcccactccttcacatcatcagacatccataatattgtcacatctgttcgatgtgtagcaatcgtaccagccataatatcattaaattcaaaaacattttgaataaactctttttcttgatgatctattgttcctttttcacttcccgcatcaacaagcatacgtatttcttcttcacctacttgatcttccgcttcatttggatcaataccacaaatcttcaagacaatattggttgatattgaaagaaatgaaacgattggcttaaataagatagagattcccgtaaccaatcctgaaattcccattgccagttcttcagattttttcattgcgattctctttggaactaattcgccaaaaaccaacgtgaaatatgataaaatcaatgtaatcaatataacagctatggtatctaaagtagaacgtggaatattcacacccatcccaacaacccaatcaactaaaggttctgagaaattatctgctgcaaaagcacttcctaaaaatcccgacaatgtgattgcaacctgaattgtcgcaagaaatcgtgccggctcttgcgttaatcgtactaatctctttgcccgaccattaccttgttctgccattcgttctagctttgtttcattcattgataaaacagcgatctctgcactcgcaaaaatcgcgtttaatataattaaaataatctgcactactaaaagaataaaaattgatgtactcataaataaaacctttctacaataaaattatctaaatatcacacttacttaaaagcaacaaaaggcatggtctatgttccgaatacatagtccatgccttgcgatatataaataaaaattctattgaattggttcgcttcagaatcattatcactttcgtccatgttaaatattcctcctctcaaatagtattgtagtacagtataacaaaaagacctaacataatcaattcgaaaaaagtaaaaattgtgttaaatttatgtaaaacataaaatccgattatttttaatttctttgggaaattcaattttctttatcatcacttaacatcattttaaagtaaaaagcaagccattttcagacttgctttccaccatatcatcttccttattgataaatcatttctttattcacaatctcccttgcacatgcttgtatatcactcattctccctatccattctaatgtatcatctgcttttagttgttctgtaattccctgtgcctgcttcatctgctctacaatcctttcaaagagttcctgtgcctgttcttttatatcagccagataatcattcaaccttccacttgtaatcagattcaaatatatacctctgcgatattctttcaaataacgtaaatgcctttgtccccatacgcctataaatctctgttcttcttcctccagcaaggtaaaacaggggataagataatccccatgtcggatataagtgccgcccatttcttcaaatattgttttcttcattgtctgttccacctcgtcttatcgttctctatccattgattttttcttaactgactgtttcggctgctgtctgccttcctgctgatagaggtgcagcttttccagtacactctcttttttcggctgttccaacgatttttctttcttctgttccgtctgatttttccatgcccttagttcttcattgtattctataatcagtccttctgctttgttataaaccttctgaaaggcttgcacattgggatagccttcacgttttactatctgttccaaactcttgtgcagacgcttttccaaatcctctaacagttcaattcgcccttccagagattttcgctctttgcctttaaatagtcctcgtaactctgacagttgctttttcaaagaagaaatatcttgctgtgtgcgttttatctctattgactgtctctgcaattcatacatgagcttctgcatatctttccattcctgcaaatcaatctttggtacaggtttaggcggtagtttaaatttgaaaattacttcctgcaaaaagtctttcgcacctcggataatctgactgaacatatccggcagccaaccgtgtgtcttgatagattgcagcgttttgtctgtgattttttcctgctttatcttcaaaatatcttcttcaggaacgccctcaactaatgccacatcaactgtccgattccattcctgccttgccgcattgtccgcctttatctcctctgctttcgaattgttctttcctattttcttggttgccagatatacgccgctctgttggaatacagagagtttttctgattcctcttttacatatcggttgatcgtatcggtaaacagttccttgacttctttggtaaaggctttattcttaaaccattcatcctttttcgtgaagatatggctttcataaacttctccttttgggataatactgcaccccgcccgaagattgccctgctcgtctaaaacctctttctttgtgagtctatgctttccctgctcatcataaaacatatttcgggtagcaacctttacttcgggttgttccaacattttccgttcactaaataccagatgaatatgataattcgtctttgccttgttgtgatgaagggcagcactgcattccacaccgtatcttttatgaaaagtctctgtcttgatttgaagaaagaaaatgtgcatttggaagaacaatattttgatgtaattgacagtaaaacagaaaacggaatccgaaaagttccgattgctgataagctcctgccttactataaagactggtataattcttgtcatgattgcgaatatcttcttcatacagaggatggcaaaagatttctttatcgcaattactatgacagctattggactcctcttgtggaacagattggaattgaccgtacaccacattgtacccgacatacctgcatttccatgttatcggaagctggtgttcaggatacaacaatcaagaaaattgtggggcactccggtgctatgactttgacagaaaaagtttatactcacttagatatgcaggttcttgtagacgcaatcaacaaaaccttagaaaatgaggacagcgtaactgccgatacaaaatctgcatagcaaaaaggacactctccagtgcctatcaccgaaaagtgtcctatattttttagatatttttgttgcaaacgtgttgcaaatgcgttgcgaactgagtaaattccaccgcttttcaccacatctgacaactccacaaacccttgtaaaacaaggatttgaacgtaaattcgagttctgaagattatctcttgctgaactgcggagcgcgacgagctgctttgagaccgtattaaacatctctatggtgcgtttttccttgatattacgggctttttcgcattttctgttgtcggttgtcctattccttaaccatggaaatcggtgatttttcatcgaaattctcctggttcaaagcatcattcactatctcgaaaagttcctctggtttattatacttgaccctcgcgtaaatgtccatagttgtcttactattctcatgccctgccaggtactgaactgtcttagggtcaacgcccgcatagagcagattcgtgatgtaggtatgccgcaacaagtgcggtgttacatcgaaattcagggtatagcgaatcttgggattgttcctctgccttgttcctaatgtcggcttgacggtatatttaatgctctgtccattcacatatttatagtaggttctctcttttgcagaacgaacaactacatactgccaaactctcgtaaactgagaataggaaagcggctgtccttcactgtcggcaatcacatactccgatatggaatttgcttttgcttcccgcagacagcccaccagacacttcggaatgggaatatcccttttagctgcctttgtctttaggacggtggagatcaccggcctgttatgctccgcgcgccatgcccgccgcacagaaatgtatggtgtggattcatccaggaatacacagtcccattgcaatgcaagaatttcttcccgacgcaagccggaatacaaaccaatcataataaaaagatatggcggaagctctttcaccgtatccagcagaattgcaacctgttgatctgttaaggcgtctttctttttcgatgcttttccgccctttgctgaaattcctacacacggattatcggttatcagctgactgcgctctgccgaataaaacacacacttaatcagcatatttaccgtatcatacagtcctttcgatttttgagatagcggaacaagcgccagacgaatatcatccgcagtcacttcctccatatacatatctcccagagagctaatgacataattcttcatattctgtctgtatccttttatagtagccgtagacacctttgctgactgcatcagcagccatttctcacaatactcggcaaccgttggatgctttcggtgaaagatgatctcatccacctgtctccgggcctccaactgcttttcatataattcttcacaggtggtcgcatataagctgacctgctttccatcggcatctgtaattctggttctgtaatacagtgttccttttcttgtaaccgttccgtactctggaacgctttgttttttcttagccatacaaatcttcctttcctgataatgagtgttcttaaattcacaccttctttttatcagaaagcactaacttaatcaaagatacggattatgaaaaacaaagagcgagacatccttgcctcgctcctgcgttgtttcctgcttttataatgttatgcctgtgctgcatcccactgggcaaatgcaccacccattgttcttaccagctcatccggtctgttgtatttgacctttgcgtaaatgtccatcgtaattttactgctctcatgtcccgccaggtattgaaccgttttcgggtctacggacgaatgaatcagattcgtaatgtatgtatgccgcagctggtgcggcgtcacttcaaaatctaagctgtaaatcacttttccgttatgtgctgccttttcaccgaggaccggcgtaaccgtgtgctttacacgctttccatcctcgtagcgataatagaaacgctccttgacagttcgggtcacaatatactgccagagccgcttgaactgcgtataggataacggatcaccgtctctgttcgacactacatattctgactgtgaattagcttttgtctctttcagacagtccgccaggcaaaccggcaacggaatatttcgatgcgcggctttcgttttcagctcatccagaatcaccggtctgttattttccgtgtgccatgccctgcgtaccgttaaataagggcaatccacatccagatatacagaatcccattttagggcaagaatttcttctcgccgcaatcctgcatacagccctaacatgacaaatacatacggcggaagtccctgaatggcatccagcagtctggcggtctgttcatctgtcaatacagctttgtccttttgcggaatgcctccgcctttggccgtaaggtaaatcgttgggttgttatcaataatcttactttcctttgctgcccggaaaatagatttatacaggataaccactgacttatataccgaagcggacttctcagaaacaggaacaagtgcaagctgaatgtcatccagtgtcacatctgccatccgcatctgccccagttcttttataatgtgccgtctgacctttgatgtataatctatcagcgtggttgccctcacatgaaccgactgcatcaaaagccatttttcacagtagtctgcaaccgtcggggatttccggcagaatgtatcgttgtcgatctgctctaatgcacccaactctttatcatataattcttccggtgttctcgcataaagggccaccagttttccatctgcgttctgaacccgcgttctataataatctatgccgttaagcgtaactgtaccgtattgtggaattgctctttttctttttgccaattccgccacctcctaagaatatactccagcgctgtatctatgttttatcaaaccattccgattccggcaaggatacggaccggctcacactccagctctgtgaggtttacgataagttgcgttcttttctgctggctttgctctgtgggtgcattttgcgatatactcctgaaggcccgctgaggtaaagtacacacagccattctgcacatattgcacataagaaataagaccattgttacgggccacgtccagcgttgcaatgctgatacctaaaatttctgctgcttcttttcgtgtaataagtttttccataaagcatatttcctccaatctgtcaagtttgtcatcgtgtttgttcaaagccacatgaatacgctagcagccgaaactgccagcgcatggtatctgattttgaacaggaagctgcaaacacttcctatttatataactcagctttcatcacatttgccacgccccctgacgatgggaacacaacaggtctccgctggcgcggctgtcataactccgcagcaccgttcatatcgtgtgccgcagggttccccccaagtctttggcgggccgtgaggaagtatctttaagcccccatgcagtcatcgcgccgaatctgccacaatccgttttatgaaatcgtagatcgctccgaagaagtcttttcatcacctccctgactgctccatcttcgcggcgtttcatattcgctcgtacatgggttatgtacctgttgtgctgtctattcgattgtcaatgtactgatgaaggaggaaaacttgtccttcttattaacactgacaaaaaaggcaaaaaacaggcgcatcaaatgaaactttatcaaaaatattttacaagctgctttaatccacggcggatactgtctcggacacggcttgggtctacaccttctacttcggcaatttcatttaccgtcattcccagatagtatcgggcataaatcctctttgcctgtttctccggcagcttcatcacagcggcatagacctgctcctgaaactgtttttcctccagaagcatctccggtgtttgcggcttcaatagcaccgcattttcaatgccattctcgcaatccagagaatactgcgctttataacgatacatctttcgctcatacgcagcctccgcacgttcagctgctcgaatagtctccattacttcctctgtcacatctacaaaaaagtctgttgtataaacatcaggataaagttcccgaaggttaattttcttcattatgtacctccatttcgattcacgggtgattgacgggtgaatcgaatggaggcggagaccgacactggcagacaaccgggtcatctccgaaaaaatggcaacaaaaaacgccagatttccgtgagggaaaactgacgcgccaagaacagccattattatactgaattacatggaacgataatgccgatgcaatgttatacttgcccggaggaggagcaatgctttttttaactggtgtagatcatggatactgcaaaaaggcaaaaaggacacggcgatacctcctcggacaccgccgtatccttaaaaaagggcgactttatcacaccccccgcaaatccaatttttcaaaaggaaaacggcggcttgaaatgcaatatttcaaaaccgccattctgcgccgcaaggccgaattcaacggtcttgttatgtctgccaacacagttgctaccaaaaagaaaagagccgataaaccgtttgcctattggctacgggttatcggctctgcgtctgtgcgtctggctcttttacaatcgaaatattcaaattttgtgcggtaataagtgtttcttgcttacacttaggacaatacagaggaaaatttatgagtattgtatctcctctgatttttaagcgtgttttattacggcatacaggacataatacccattgaatttctggcaagcgtttgccctccaatctactttttcttgttcttcttccaaactttatataaagcgttcaagataggaagtaaaacgcatattacaacaaaccattctggaaaatgtggcatattacacctcctcgttctatgctaaatgaaatactcctactacaatgcaaacaactgtaacaaataaggatacaagtattctcgctaatgaatagctatataatctttcaggatgttgcaaatcatagcgaacagtcacagagttacccacttgggctgtcaaggggacttgtatgcgatttcctgaaacataggttttcccatccacccgataggtgacttttgcccactttgaattgcgagtctttgccgtttcgggattgggcgaagtaattgagttgatggttcctgttgttttcccagttatatttctttttgcccaaaaggcaagtgcgttgtaaagagcaaaaagaaaagagactgacgcaattaaatataaaaagatcgtgtcgtttttcattttcgttcacctccaatcaacaaaggcgctatgataagtcagccttacagtacaccttaaccgatattccagcagacaccgccaatacaataactccaatcaaaatagctccggcagacaagatgcttggcgatagagcaattaagggataccaatttgcgccaccctgcattttcagtaattgcggcacaataaaaggagaagccataataatgataaagaacgcaaattttgtcgtttcatatcccaacttatattgtactgggaggtaaataccaaggaacagagccacaacgaggaacataaccgctgacagttcaatgtgaaatccaccgagaacagggaataacaatgtctctgcccagaaaatcaaacagcaagcgccataaatcagcaagccaaaaacatatttagaaagtacaagtagtttgcggggatatggtgtagcacaaagtagtgtggacgcttttgcgtattggttctccttcaatgaaacatactgcaatagcataaaaacagaaaaaattgcagctaagataaagctcatagaaccaacataagttgcgtcgtctattcgccacatcataaacggcggtataaaaacacagaccgctaacataagcaaaacatacttcttcacgataagaaaatcttttctaactagatggattagcattatttttttcctccttcaatacttcccaacataatgtcctcaatcgttggccgttccaccactacatcaggaataagtcgttgcacctcagaaatctttttagtgataccggaaaaaccaaatgccgtttccgtagtgcttaaaaataatttacgggtttctgcatttagataacgcacatccccttttacaatccgatagtagtccagcagagtatctttttcttcctgaaatacgatgtgaccattatcaatcataattagcatatctgcgattttgtccaaatcagatgtaatatgtgtagagaagaaaacaccctttccgccactattcatgtaatcggtaagtatagttaatagctggcttcggatcaaagggtcaaggccgctggtaggttcatccataatcagaagttctgctttatgagacagcgccagtgccaacgcatatttcattttcatgccttttgaaagcgtattgattttctgttttgggtttaggttgaaccgttccagatagtttttgaagtcttgttcacaccacgatgtataggccggagagataatacttttcatttcagctaaagataattcttcataaaaatagccatcatcaagaacaacgccgatgcgatttttaatttcctgctcatgactttgcatatccaatccaaaaaattcaatatgcccagaagttcgattagtaagctctaaaatcgtccgtaaagtggttgtttttcccgcgccgttcaccccaataaatccagtaatgcacccctcaggcaaagaaaagctgacattacttaaagaaaaattaccgtatgatttgttcaaatcggaaactttcaaaattgattccatttcaatcctcctcgtataatatatccatcatagaattaagctcgtctttgctgatattaagtgattttgcagtctgtatcatatccagcattttttgctccacaagccgtcgttttgaatcacggagcaaatcaagattgctggtagaaacaaatgtgccaattcctacctgactggtaacaaagccctcttgctctaattcttcataaacccgcctaatggttaaaacactaaccttcaaatcatttgcaaaggcccgtattgacggtaacgcatcgccctcttttaattcttctttcaaaattgcgtctttgatttgctctttaatctgttcgtaaagaggggaatcagaggcgtttgatattagtatcttcacaagttcattatacctcctgtatggtgtgctgttgctatatacacactatacactataatcactttcctgtcaaccacgcccgaaaggacaataaaatactactaaaacataaaatttagtttcgttctcataatcagacccgaaatgtacaatgatatagggtgatatgagaatgaaccaagatgaaagaaggtttgactttcatgggctcgggctcgctttgaaacaggccagagaggaaaagtgtttttggcaaagctactgcttgaaaaaccagatgtattgctattagatgagccgacaaattttcttgataaagatcatgtttcttcactcaaagatagctttacaaaatacacctctaaggctactacaataggtagggcgcaaggtcttatgcagaagcactttgagaccttgcgccctctgttattctaccctaaaaatactttgccagctgcttcagaccacgccggatgctgtcacggacacggcttggatctacaccttctacttcggcaatttcatttaccgtaattcccagatagtatcgggcataaatcctctttgcctgtttctccggcagcttcatcacagcggcatagacctgctcctgaaactgtttttcctccagaagcatctccggtgtttgcggcttcaatagcaccgcattttcaatgccattcccgcaatccagagaatactgcgctttataacgatacatctttcgctcatacgcagcctccgcacgttcagctgctcgaatagtctccattacttcctctgtcacatctacaaaaaagtctgttgtataaacatcaggataaagttcccgaaggttaattttcttcattatgtacctccatttcgattcacgggtgattgacgggtgaatcgaatggaggcggagaccgacactggcagacaaccgggtcatctccgaaaaaatggcaacaaaaaacgccagatttccgtgagggaaaactgacgcgccaagaacagccattattatactgaattacatggaatgataatgccgatgcaatgttatacttgcccggaggaggagcaatgctttttttaactgatgtagattatgtgagctttgaaaaagcaaacgagacacggcaaaataacctccaatcggctaccgtgtccctgcaagtcgtcataggattgtgtaaacgcaaagaaacggcggctctgaaatcaaagccgccgtttcaaatgggcgtgtcaaattgtctgctctacgacggctttttttcttttgccgtcgtccggcagattttctcttttaaggaaatatttatgaagttctatgatacagcaagatccaataagtctactcactttttattgctgataaaatactcgcttttttcaattccattttggaatacatcgaaaaaacaaggtatatcaccaataatacacaaatcagtgccaacaggaaaaaccacggtaatttcaacgtaatacaatgattgatggcatctaatcgtctgcatacaattacactaaaaatacttccgcatataagagatattgccaatgaacctccgaggtaaattccaatctccctattcagcattgctttcaactgttttcgcgttaccccaacagcttccaacagaccgaattcacgctttctattctgaaaatcaaccataagcatattcataagactgatacttccaaagacgaacagaatagcagaagtcatatatagagcatttatagatgcactgtatcgatgctgaatatttttaatcgtttgttcaatcgtatttacttctattttttcatttttatccgcaatcttctgaactgcggtcaaaacttcatcaaaacatccctctgaatttttaatcgccagaatccccgtctgttccgttatccctgtcagtttctttgctgtgtcataagtcataatgaagtaggggcttccaggaacaaccgggctatcctccattaaatcagatctattgtatgtgcctacaacaacggcttccacatcaaaggttctaccatcaaaagctctgccctcaatcttcaaagtatcgccaacttgtgctatatcttctgcaaccaatattccatttttctcaaccatatcatcgtaatctgctgttccagaggataacgccgcctgcttttcttctgtctgttcccgatttaaggttggaaagaagtctgaaatgctcgtgatagaaccactttcgcccgaaaaagtagctgtcatataaacgctgtcaaatgcggtaatcttttctatcccatctaccttttctaattcctgcatcaatgcctgatcttcaagtggattttcttccagttgcaattttgcacttccgtatggctccgcttcgttatcgaaagagctgccaactgtatttcttatttgtataagaatgttaccggcaggataatatttgaaacttgcctgttttgccggatcaatagaaccagcaaccgtagaagtaaccagtaaaagagctccgcttactccaagcattaaaagcgtcagaactgctttttgtttgtttctttgtatatttattttcgccagattaaacggcgtaagtttccgatgcagttttgagctgctttttgcctttccagcatacgcaaggtatttagcaccctctaccggggaagtattcattgctactcggacaggcttaaaaatggcaatattcactgttacaaaggctactgcggcaatcagtacagcataaataactgttgtttttagccggaatccatcaggacagccaataaatccaatcagtacaccaatgacaagccccaaaggaataccagctaaggcatataaacgtccctctttacttgccatccgtttaatctgtctttttgtcatgccaactgtccgcagttgcccaaacatctgaacattttttacaatctttgtgtaaaaaacaccatagacaatcgttgccgccaaaatagccgtcaacgccgccagtagtggtactggaatcggaatacccgatgttatcacacccgacataacagcagaatactctgtaagcattacctgttcctcgacaatgcctgtattttgtattgctttgccggcaaaattaagaatagccgtggaacttatggcgtctgtattcaaccgcgtatatgctgtaacctgaaaagaatcttttgccaaatcttgggcaagctctttactaacataaataaaatatccgttgctttctttcgtattattcaaaacacctgaaagtgtatattctgctttctgtcctgttccagtcaggtcaatagaaattgtatcgccagtctgataggattttcctaaaaaatcaaggtagttctgggggagcataatctcatccgctttctgcggcacacttccctgaaaagttttttcttcctgatgtaaaaaataatcttcatttccataagcaacagtgattgttttattttcaacataaaacacacctatagcggaatattcgccaacccatgtaatattttcgttttgatgcagctgagccgtttgttcgtctgtaactcccaaaatgccaatctgcgctttattcctctgtgtgttcttgaatttctcttgtgtacctgttgatattaggagaatcgaaaaaaccatacagacagagatggcgattgtcaaaagcagaaatgccttgtttctcttatccgcttgcatactcctacctgccaatttttttacaatggcacttgtatcattttcaaaaggccatgtcatagtctgccacctccttactccacaatcttgccatcctcaatgcggacaatccgatctgcaaggcgggctatgtcgttattgtgggtaatcatcacaacagtctgccggaactccgcacttgtgcgcttgataagccccagcacctcggcgctggtcttgctgtcaaggttgccggtcggctcgtcggccagcacgatagccggtttggtaatcagggcgcgggcaatcgccacacgctgctgctggccgccggaaagattgttaggcatatttttcagtttatcttccagccccagcaggtgaacgatctcgtccaaaaacttctgatccaccgtgtccccgtctaactccaccggcaggacgatgttctcatacacattcaggatgggaacaaggttatagttctggaagataaagccgatgttgcggcggcggaagatggtaagctgctcgtcgttcatttttgacagctctttgtcccggacaatgacattgccggaagtaggggtgtccagcccgcccatcatgtgaagcagggtagacttgccgctgccggaggttcccacaacagccacaaactcgccgtcctccacggagaagttcacgccgtcaagggcgcgggtgatgttcggctctgtgccgtaatactttttcagatcaatcgtctgtaaaacgctcatactcaaaactcctttcaaggctttctgcctgttgataagggtattgtaaaacccaaatgtccgcgaaatgttacagcggccaaaaaatttcattgaaaatcagggtgaaatgttacaacgctcggacatttcaaaaaaatttacggcggcagccggaaatggccgtccgccgcgttctattttgtaggcagcataatggaaaattccgaacccttgcccggctccgaaaccactttgatataaccgccctgtcgcgttacgatctcgcgagccagatataggccaatgcccacgccctgctgttcgtgtacttcttcctcacgatagaagcgccggaagatggcggcctgattgctttcagaaatgcccttgccggtgtcggtcactttgatctccacatacatttcccacagcaccaccaacacagcgattttcccgcctgccggggtgtacttcaccgcattgtccagcaggttaaagagggcttcggatgtccacttgctgtcatgggaaacggtcaaatcctccgggcagtccacggacacggcaatttcctttttctccgctgcatacacgatcccactcatggcctgcgccacagtatcaaagaggcggcccggtttcttgttcaactggatcacgcccgtttccagccgggaggttttcacaagggcctgaaagagaaagtccagcttatccgtctggctgcggattccccggataaagtcggtgcgctccgcctcggtcatgggcttttccagcagggtgtccgtcgccattttcagattgcttaccggcgttttcacttgatgggaaatatccgatacaagggtctgtaactcctgccgttcctcgtccacccggcggcggttctcctgcatgatctggtaaagccttgccagccggtgcccgattctggcaagctgggtttcgctgtcctccgggcgctggggcgcttcatttccagcgatcatgtggtctaaagtctggcacaggtcagcggtaaactgcgatagccgctttccaaaggtctgcgttaatacgaaaatccccacaagggcgcacaacagcagcgccccgcccgtcagcagcaccgcaatctgttttgtcacaagaaacagggctatggtgatcccggacatggagaggacaagccccattgccacccggccaaacagccgctttaccgagaggttttgaaacttcattttgcctcgcctcccgtccattgatagcccatgccgtaaacggtcttgatgtagggggcacctccgtcggattcaatcttgctgcgaatccgactgatggaggttgtcagggtgtgttcgtccacatacttctcgtctatatcccacagcttttccaaaagctgtccacgagtcagcacttgccggggatttttgcgaaacaggttcagcattttgtactccatcggggatagagtcagaggctttccatttaaggaagccgtctgctctgaaaagtccagaaacagccgtccatcgtcgtaaatgtctttagctggtttgtggtgttccagcatggcgaacatggctttgatttttcgctgcaaggctctgagcacaaagggctttgtgatgtaatccaccgcgcccacctcataaccccgtatctggtcgctctcctgatcgttggcggtcaggaaaattatgatggtgtccgggtgctggggctttattagcctgcacagttcaaaaccgttgccgtccggcaggttgacgtccagcagaactaaatcaaactcccgttggcggatggcatcggctgcggttctggcgtttagggcagaagtcacgccatagccatctgcggtcaggttataagtcaacatcttattcaaaaaactgtcgtcctcgacaattaaaatctgcttcatatcctcacttcctttgctttttgcagatagtataacaggcaaatgtccgcgaaatgttacagcggacggattttttcaaaaaaatttccatctatattataagttgatccagttagtgatacaaggatggtattcaggtctttattaaaaaccggcataatcaaacctatcaaccggtataataaggttattcctttgtgcaaatcggcacgatagaatatacttgaggtggatgattatgccgattgatgatttaactgctttagggcagaaaatgagaggggccagaaagaataaagaactgacacaacaggaactttccgatctaagccatgtttctgtaaagcaaattgccaatatcgaaaaagggaaaatgaacccgtcctatttgattttgagagcattggcaaaagtcctgcacatctctttagatacgcttataaatccagatatttctctggaggatgagggtgtcaatcagatgaaaatgctttattccagctgtccgccagaaatgcgtgacaccctgttgcatcacacccaggaaacggtgaaagagctaacagagttgtccgagaaatttgaaatgaattgagccagtgagtgaaatttaacgattctctcactggttcttttcattttcggagaaaagaggcaagcaatgcctgtgttaatacacacaggcccgcagagaagaaaatccctccgtgattttcctctccgcttgcttgttgagggcagcgcccccaagcccctttgaacacagaatttcattctgtggctacgcgttctgcgaacgcttttgaccaggaccagcttaccgctggccgtggtctttttctttttcaacatcctgttctacctccattttcagcacccgatccacattggcctttgccgttaaaagctccctcatttcttcacgggagcgccgatactcggaataagtctttttcttttcttccagcaattttgcgtactctgtctgtaactctttgacctttggcagcttcttgactcccatctcatcaaaggcattcttagcagcctggtggagcagaatttcttcctcatgttcttcccggaatttcttagaataacccgccttgcggtatgccacatagacctcacgggtcttggcataatttacgatgtgagtacgcagaacagcggtctctgccatgcacttttcagccgctttgatctgcgccgaaagatcattgtgatgtgccgtggcagccgtagccttttcttccaaaaccgcatactccagcagattgttctctgacaggtaattcatggtctgcgccatttgtttcagattaaaaactttagcccatcgagcatagccagcaccttttccagcctgcaattttgcctgaatgtccaccagcagattgaccttcggcggctccggctgcacgacagattttttacggggcgtatgctgtttttcaccggccagcaccgcacggatttctgcttcactgtacccggcccccagcttgtcatccatgcgggctacattcttccggccgggagctttgagccggatcgctttcccgcgccgggatacttcacagcccatttccgaaagcagcttcagcagcgcatcaaagtccgctggattctgctccagcgcacggtcaatcatcacccgcagctgctcccgatgggagggcttggcctgatcgcccagccatttgttgtagctttttccgtggggcttgggattctccacaatggacagtccgttctcgatacagatggtatcgctcaagcgccggacggctctggtgctgccccaaaagtttcggaacttccggtcatattctaagctgaccgatgaccagataatgtgattatgaacgtgggctttgtctatatgagtgcagaccacaaaggcatgattgcctttagtaaaacgctttgcaaattctacgcccagccggtttgcttcttccggggtaatctcaccagggcggaaggactggcgcacatgataggcaatcacatcatctgcgccacgcactcgtccagtagcggcaatgtactgccgctttgccagaaggaactccgcatccgcagtccggctgtcacacgcatagccggtaatgagcttgccgttatctgttttctgtggatttgctacatagtcgatgatgtcactgattgcccgactttctgtgcgacccttaccaacatgaagcggcatgattcttgtagttgccataatagaaggccctcctctcataaatattttttcgctgaactctttgcttctatcgttgcaataactttctccgctgggtataataaaaaagaacattctacaacctcaagggagggattttatgatagaacagctcattgccgaagcaacggaatgtgatttcaaagttgctctcgaaacaaaaaagccaaaaagctggttaaaaagtgtcagtgccttttccaatgggatcggcggcactctgtttttcggagtctctgatgaccgggagcctatcggcttgtccgatgttcaaaaggatgctgaagcgatcagccgcttaatcaaagaacgtatcacaccattaccgcagtttatcttaaagccattgcaggaagatggtaaaaacctgttggctctggaggtttctcctggccgcagcaccccatactattacaaggcagacggcgtgatggaggcatacatccgtgttggaaatgaaagcgtaattgcaccggattacattgtgaatgaactgatcttaaagggaaccaatcagtcctttgacaccttaacaacagaagctgtgaaaaaggattacagcttcacactcctggaggcaacctatctggaacgaaccggcctccgcttcgagccatccgattatgtctccttcggtttggctgacaaaaatgggttcttgaccaatgccggaaagctcatgaccgatcagcacacagtttataactcccgtatgttctgtacccggtggaatggcttggaaaaaggctctatctttgatgatgcgctggacgataaggaatacgaggggaatttgatttatttactgaaaagcggcagtgaatttattcgcaataattccaaagtccgttttgtcaaagaagctcagtatcgggtagacaagccggattatgctgaacgagctgtaacagaggctcttgtcaacgctctcatccatcgtgattatattgtgcttggcagcgaagtccacattgatatgtttgatgatcgggtggaaatcacatctccgggcggtatgtttggcggcggctcaattcaggaatacgatatttacagtattcgttcgatgcgacgaaaccctgtgatcgctgacctgttccaccgcatgaagtacatggaacgccgtggaagtggtctgcgcaaaatcgtcagtgaaactgaaaagctgcctggatacacagaggcatataagcccgaattttcctcaacagcgacagatttcagagtcatcttgaaaaatgtaaattaccatcatggtccttctatcatagaaacgacccatgataagacctatgacgcaacccatgatgcaacccatgataaaatccttgcattttgcatagaaccacattcaaaattagaaatcgcagaacactgtggatacaaaaacacaaaaaactttacacaaaaatatctgcgtccgctattgaacaatggaacacttaaaatgacacttcccgataaaccgaaaagtaaacatcaaaaatatattacagttcgttccgaataaacagagaagcagggcagtgggtctcatctcccattgtcctgcttcttttcattccaaattatattcacatcatttacccatacacccaatcctggatcgcaaatttcaaactctgcaccttgctcagcagccagatcgcagccagcggcagccccatcgggctaatcaaaaatgccataaccagcaaaatcacaccattctgcgaggaataggtaatcagcacagccacgccaagcagagcaattaccgtgcttagtagaccaagcaccagaccggatatgtagatcagccccgtgcagagccagacaaaaagcgtcaacaccaaaatgaccggtgcagttacgatcatcagcagacatttcaaaatcttcatttctgttcctccttccaacgctccagatactgtttgcatagggcatccgcttctctctcatcatcttccgtcacttcccgttttcctttggtcagttcaatctccagataagtccggtaatcatcagctaagagatcgaacagttccttgggagtatggcacacctcgccagagcaatagtgaaaatcttggtcaaattcaactcttacacatccatggcggctgatataaacttctatggtctcgtctgcggttaggtaatccgcaaaaatctccagcaccttttcaaaggtcagcatctgttttcactcctttgctacgcttcttattctactcatattatccggtacggacaggcaaaagacaaggatacagacaaaaagaaaaagcggaggaaggtgcggcgaagaaacgccgttcctccctccgcaaatggagtatctacccctgttatgaaagtttggagagttgggtaaggatttccttcacaccctcccacagttgttcctgccgctgggatatatcctccaagtcagcattataaacccgcccggtctcatgcactttgcgggtcagctggttcaagttgttgctgcttcggcgcatcagggagaccagctccttcagctctggcagttccagcttgaccacataaccatccagcgccattttccgcagataagcgctcaaattctctgtcccgtattgctgcatcttttgatggatcagttccagttcttctgcggacacccaaaacaaaaccggcacatcccgcttgcgctttgccatggttatcgctccggctcccgttttttcggggtggcaggcttgcgggcaggcggttcctgcttgagcttttgcaggacagagcttttctgctgttcttgagcgacttttcggaactgtctggtgaacaggtcggtcaaaccgggattgacctgatctaccaccagataggcacagtggcgggaagcgccgctgtcctccagcgtaggaatgctttttgcccatgctttattgtcctgagagatacgcccgtcatggttcttgtgctggatggtgttggcaagaataaactgtacccgttccgtcccgaacttttccagcacatctttgaccgcagcctccgtatccagccgattctctgcatagtgggcgctgatggtctgctcaatggtttctttgcaggcgctgttcgcctgatatgagaggttgtactgtgccatttccccatgctcggacgcataggcagcagaatatggatagaccggtgctgttcgcagttcctctttggctctgcacacatcgtcggcacggctttcaatgctgtcccggatcacacccatatagccggtctccagcttttcaaaatagcggtacacatccgtcaatggagagggagattccaaaagtgcctgagcctgggtgtcggtcaactccagttcctccattgccatcacgatgtcctcgcggatggtgtactcataggcatggtttaagacttcttccgggggctggcttttcagccagtcccggaacttgtcctgttcggcagccatcttttcataaagagctgtattcagatcgttagtattcatgttatcgcacctcctcatgctgttttggtttcttgtctgtactgcggggttgcaccgggcgttttaggttatccagcaccgaaggccgtgtgcttttggcaacaacagactcggtgtgtgcctgcccctttccgtcgatgttgagcagggtatccagctccaccagacgggcgtttttgcttctcagttcttcttcataaaggaatggctttccgacttcctcctttgcggcagcctgctgctgatagaggttatccagctgggcctttgccgcctccagacgctggggcatctgggcgagggcattgtcgatacgggtaagatttccgcgagggtctgtaccaagggttgcccggtgggtcatctgtcctttcagcaggagcgtatactcctgtttccaagcggaaaattccacggacatggcataaccccggtagctgccgatctgcaccggatcggaggttttgacctccttgcaggcatccaaaagggctgcaccggcgttctccttatcggtcagcaggtctccacgaatctccataccagcaaaaccgtcctccgggtgcgggtgagctgtcaagacctccagatcggattcaaagcccttgataaaacccttgtgcttttcaatctcctccgggaagtatttgagcagctggtcctccagacgatattgcttgctctggtggtcggctttcatcagcttcaggcgggatacctccacatccaaatccatacgctccttgatgcggggatctccggcacacagagccttgatctcggcaaaactgagggctgtttcatccacatcatcgcaggaacgcaccggcgatttagaagtcatgatctgactgatgaatttctgcttgttctccactgtctgccagaggtatgcgtcaaaggttccctcggtcacatagcggtacacatgaacaagggggttctggttaccctggcgctcgatacggcccttgcgctgggcaaggtctccgggtctccacggacaatccaggtcatgaagtgccaccagacggtcctgcacattggtgcctgcgcccatctttgcggtgctgcccaaaaggacacgaacctgaccggtacggaccttagagaacagctcctttttccgcacttcggtattggcttcatggataaaagcgatctggtcggcaggcattccctgagcaatgagtttctgacgaatatcgtcatataccgtaaagaccggttcctgctccggcagaggcacagagccttccaatgcgtgaagcagtggattatccagcgttttcgccgccttgcttacaggagcttttgcctgcggtgtagaaatgtcgcagaacaccagttgggtcagcttgtcagctttgccatcccgccagatctgcatgatgttgtccacgcactgattgacctttgtgccaggttcatccggcagcatctggttgacgattctctggtccaggcccagcttacggccatccgaggtaatcttgagcatattgtcctgggacgggtcaacggttccgctgtgtaccagcgatgcgcgctccgaaagggccttgaccatttcctgctgatgttcggtgggctgcgccacgatgttgtggtattccacctccggggtgggcaggttcagttggtcggcagtcttgatgtccgccacttctttgaacaggttcatcagctctggcaggttaaagaacttggaaaaccttgttcttgcccggtagccggttccttccggtgccagctccaatgctgtgacggtctctccaaatcgggaagcccagcagtcgaagtgggtcatgttcagttcttgcaggcgttcatactgaaggtaacgctgcatggtgtaaagctcggtcatggagttgctgaccggtgtgccggtggcaaaaatcacgccacggtttccggtgatctcatccatatagcggcacttggcaaacatatcggaggatttctgcgcgtccgatgtggaaagaccagccacattccgcatttttgtgtatagaaacaggtttttatagttgtgggcctcgtccacaaacaaacggtccacacccagctgctcaaaagtcaccacatcgtcttttcgtccctcggcttgcagcttttccagtctggcttccagagactttctggtacgctccagctgcttgacggtaaaacgctcgccgccactggcctgtacctctgcaatcccctcagtgatctcgtcgatctgttcatagagaagccgttcctgacgctcccggctgatggggatacgctcaaactggctatgtcccatgatgatggcatcataatcacccgtcgcaatacgagcgcagaacttctttcggttatgggtctcaaagtcctttttggtggtgactaagatattggcggaaggatagagacgcagaaactccgacgcccactgctcggtcaggtgatttggaaccacaaagagagatttctggcacaagcccaggcgtttggcttccatcgaagcagctaccatctcaaaagttttgcctgcgcctacttcatgtgccaacagggtatttcctccatacagcacatgggcgatggcgcttttctggtgttcccgcagggtaatggccgggttcatgcccccaaaagtgatatggctgccatcatactcgcggggacgggtagagttcatttcttcgttgtactggcgcaccaaagtctggcggcgctccgggtctctccagatccagtccctaaaggcttcccggatagcttgctgtttttgggcagccagggtggtctccttggcgttcagcacgcggcgctcttttccgtctgcgtcctctatggtgtcgtagatacggacatcccgcaggttcaggctgtcctccaaaatcttgtaggcattggcacggctggttccataggtagtgtaagctgccacatcgttgtaggatacagaagatttccccttgatctgccattcagcagtaaaggaggaatagttgacctcaatgctgcgctggagataaaacggggtgttgaaggtctcgtacataaactgctggatatactccttgtcaatccaggtagcgcccagacgcacctcaatttccgacgcatccaggtctttgggctgggcggcggtaagagcttccacattgactgcataaaccggggcctgctgtgctgcccgctgtgcctgacgcagcttgcggcgcacattcccggacaggtattcgtcggcagtcacataatggggcgatccgtcctgttccagctgtcccggtacacggaagatcacaccttgcagttctccctccagttctgcttttgtttttccgctaagctggctcatatagctcatatccacgcaggctttttccgagatggacaccgccagtgcttcacttgccgtatccaccacagccaccgcctgatggggcttgatggtccgcttggtgaacatatccgccttgcgctccagctttccgtcctcgtcgatgacttccagcgcacagagcaggtaataggaagaatcatctgcataggccagccgatttgcacggtcattgataaggccatattttgcagaaaagctgtcatagaggctgttcagttccgcctgcttttgggtaatggtgctgtctggaaccgctgcatccatctgaaggtcgatcagttcctgcacacaatcacgcagtcccacaagacctttcacacgggcttcggcggtggcgttgaggtcagggcgcaccatgcggctgttttcccgatagaacacctgcccgtctacaatggcataagaatagttcttcacattaggatcggcaggaatggaggtgccaatggcttcgccttcgcccagctccggcagctctgcctcctgataagtgccatgaatatacttcaccgcatcatgcagctggtcggaaagctccagtccctcgatagggttcacggtgtagtccataccatgagcagtgcttaccggctcctgtctgcccagcaccatttccgggtggtcgataaaataccggttgatggcaaatccgtcctccgtctgtccggtctgggtccactctggtgcaatgtccagcgggcggtcccgcttttggagaaagatgatgtccgatacaacctcggcaccggcattctttttgaacgcgtcattaggcagacggatcgctcccagcagctcggtacgctgggcaagatagcggcgcacggtggaatccttggcgtccatggtatatcgagaggtcacaaaagctaccacaccgccgggacgcacctggtcgagtgctttggcaaaaaaatagttatgaatactgaaattcagcttgttgtaggctttgtcattgacctgatactgaccgaacggcacattgccgatggcaaggtcaaagaagtcacgcctgtctgtggtctcaaagccgcctactgtgatgtccgccttgggatagagctgctttgcgatgcgcccggaaaccgggtccagctccacaccgtacaaatggctgtttcgcattttctccggcagcataccaaagaaattgcccacacccatagacggctccagaatatttccggtctcaaatcccatacggtccaccgcttcatagatggcctgaatgaccgtagggctggtgtaatgggcgtttaaggtggagcctctggcggcggcatattcctccgtggtcagcagctctttcagctgggcatactctaaagcccatgccggtttctccgggtcaaaggcatcagagagaccgccccagcccacgtatcgagaaagaacctcctgctgttcggggcttgcctgctgtccggcagcttccagctctttcagcaaacgaatcgcattgacatttgcctggaacttggctttcggaccgccttcgcccaaatgctcatcggtaatgcggaagttttttgcattgcggcgcaggttagccttgtattcctcataagatgcttcctcggcagctttggcattgggaaaggtctgccactggccattgacctgaatggaaaccgggtgttcatccaacacttcctcaaaggttttctccggctcagtcacaggggctggtggctccggctcctcgatatgcagtcgttccaccaccacatcataaggcagattgttcttatcgcccggatagacggccacagtctcggaatggaaggccggggattcggcagccggttggggctgttcctgtccaaaaccgtcctgctgacgggcatacatcccgcgcagcaaaggcgcaacctcatcccagcggaaatacagcatagccagacgcttttcctctgcatccatgacttccagttctatgccctgtgccgtggtacggtaatcggcaatatcgccggtctccagattcagtgtctcgatctcaccggaataggctctgctcagccagtaggcgatctcgctgttgctcctgccggattgcagcagcgtggaaatctgctttttatccgcttcatccatcagtccatgagccaatacataccgcaagtcctgatctgccttgtccgggtcagtaggaagaaactcggtatagtaagcattgcggcggtctgcccgaagcagctgctcgaactgttctttgcgctctgcccggtagatgggatataccatcccggtgggcagaagctgtacggtgtcctcccgcagctcggtgatctgataggcgtcatcctcgatatacacggtatcgcccacggcatagaccggggcagcagggtcataggatgttctttgcggaattgggcggcgaactgcatcatattcctcatcggaaatagcaacttcggaagtctgctctgtctcggcagctgcaatctgctctacatccgacatcacctgttggataaacgagtcattgtccagtttttccgagtctgccacctggccgttgacgatccctctttcctccagggcttcccggatggcgatagggtcgatattgtcaaaacgatcctgttcttcttcggtatagaaccggtcctcctgaataagctgggcaagcctgcgctgtaccttcggccagggcagctgtgtttcctccgggcttccgacacggacaacgaacgggctgttgctgccaccgtattcctgagccagccatacagcggtatctttttcccttgcatggtctttcatataacggacaacagcgtgtttactctcgatattgccgttccatgcacaaagggcagtatcaatatcttcctgagaaagagggcgcagaagttcatggagcttttgataggtttcgtcgatcacttcccggtgcagacgctggcggaactccggtatatcagaataaaggcggatcagttccatatccttagaaccaaggaccgcacggcgcacagcggcattgccctcgatgacagcattttcacggtcagaatgaccgcaggcattgcggtatgctgcatcctcggaaatggcggcagtcaccacaggcttatactgctcaaactgctcccgaagggtaggctttggcgtttcttcctccacctccacctccggctgctgggcttggatggcatcttcttctgccagttccttttcagcttggattttgtcatactgcgcctgtttctgttcggtaagatagcggcctttctgaacaagagaggtaatgcgcttggcaaccttttcccagttcaagtgaacatccgggcagtcctgctttttatagtgcagtcctttcccatcgtgatcttcaccgctgtgtgttgcgccggacagggcatgagagtgtccgccaatgccatactcgtctttaaggaatctcactttttccttatccgtatgattttccatgaagaacgcataaatacggccttttcctccggcaaaactgctgccgccggtcatggcggcgtcgatctcatcctcggtaatgaaatgctggacggttggcacttgggaaaggtccgaagaaaaagtcctgcggggcaggtcaaggtctttcaggttctcccagatttcccttagcctatggtagtgaaagcgcagcagatcacggtcctgctgataggcagtccagaaggtggcgtattcttccttgagtgtctggcggaaagccgggtcattcagctgctccgtcaggcggcgggtctcctccgggaacccattgcctctgatctctgacaggcaggacaaatatccggcttttctggcgtcctcactgagatcgtgatacagatgccagagcttttccgagaggagggagcgttcatagcctgccgcttctgcaagctccacattggaggcaaactgaccactttccaaaagctccccgatacgctctgcggcgctctcccaggaaatgacctgggcagacctgtcataacggacagacttcccatgggaaagatggataccatcctcggcataccatgcgctcacactgccaaggccattgccgccgtggtacagcgttttcagtatctcggaaatctcagcggtggttttctgcttttcaaaggctgcaaccacacgctccctttgacggtctgtattgccgcccaaacgcagcacatggtcgatgtcattttgggcaaaagaaaaagcagaggatgtatgcgctacattctctgcttcatctatgaattggatctgttccgcttcggagaggaacaggtttagagtcagctgttgataagctccgccatcaggatttcctcggcctgagctttgcaggtgttcatcagccccacccacttcatgggatcgctggctttcagttcctcggtggctcccgcttccttcgccagctggggcatcatctgctccagtctgctctgggcggtctcgtcgatctccagaaggtgcgggtacaacttctcgctcagcaacatctggttgtagaggatgggacgatgttccttcaggtaggttttcctcatcctgccgtacttgcccaggggtttctccggctgctggctcaacttcaggtcgggaatcagatagtctccgttctggatataggtcatgggattgttcatcttgtttgctcctttcttggttggcttcgcgctctgcatttcggacggtaacgccgatctgccgcagcacctgctggttgatctggctgaccgctgttcccagcgccccgatggtggacggggtattgaaatcaaagattgccatgaaatcttcgtggtcgaagtagcgttccggctccagtccacagcgggacatcaaagcgtaagtgatgctgacggtggcggctgccttgaactgcactccgatgttatactcatcatattcctccaaaaaggaaccgtcaacgatatagaagaagtcctgctgatgctccgtccagtattcctcggccagttttccggctacctccgtgagctgtccggcaagatcatcaccggaaacatcataggtgcgctccagcatggcctgcacggaatccagatggcgctcctccaactgccacagccagggagtgcgggaatgttcacgggttccggtgtcggaaatatcaaaaacatagcgcaggcggggcctgtccccggaatcgtccaccagagcgattcccttggagccgcgccttacataccggcccatcttttcattccacaaatcgtactccgcacaggcggtagcgtccggacgctgggcgtaaatcatcagctgctcatggaacgggtacttgtaaaggcgggaagcagtggtgagaaaccctgcccattcctgccagctccccgtgagctgcgttgccaccttctccgccatctgtgcatatagttcagctttggttggcatagtgttctgtcctcctttcagttttggagtaaagaggtggggtggcatattgccaccccatccctgcgattatggtgtttactggtcaaaatccggatacaactccagctcggcaaactcggcatcactcatggcctggagcttgcccagtgcgctgtctgtcaactcccgcagctcggtttcctccggggccagctcgccgcgcatctcacgcaggctgtcgatcagtccggtgcggctgccggtattgtaaatgcacatcaggttcatttcctcaaaggtaaagtttcccatatcaaatctccctttccgcactctttttgggtgctgtctttttgtgttctgtcttgggctggcctttcagctgctccatgactgactttttcttttcccgttccttccgatgaacggcatcagccaagtccatcagggaaatgggctgaccgcttcgggcctgctgttccagctctgccacggtcggctcttttgggccattgttgatgataccgtcgatcatgccgtaatcgtcctccagcatcatttccgcatttttcatcgggttttctggcaggaatccgaggatctgggtaaaaccaacactgtcacagtaatgacaggataccttaccgtcctgtctgatcgcaacgatgtcgctgacgctcatggagggactgtgaaagtccacgggcttttccagattgaattgctgatagagtttttccagctgctccggcacagtgccagactccctcagaggagctgtgtaaatgaggtcataattgctgcggtctatggaaatgtcatgggactttaaccaatccagattcataaagcgcacattctgcggatcgtcacgacttacctgatagatggcaaagcaatctctgttctgagagagaaatgcctgttcgcgttcctgctgatgttcctgacgctccatgaccttttcgtggaactgagggcttttctcccattcctcatggtccacaccgaaaagaccgccatgatccatgatttcctgcggatcaaacaccatgctctccgtattgtcctcatgcagcacatagacggtcaaaccggcggcatccagttccagcgcccgttctctggtaacagggagcatcccatcataggagtagccatattcctgcatatccggtgtggatacctgctcatccggcatggggtattcatccagtgcctgctcctgcgcttccggcagctgggaagaagcagtcatctgactggtctctgccagcatttgctgataggccgcttcctgcaagttctcaatcatggacataggagcgtgtctgagcgaagtgctgtccagattgttgtcatcacaaatctggagaactgcatttttgcgggaaagctccggcatatccagctgaccgccatccagctctttcatggacgcggcatcataaagtgtatagtcccatccgctgtcacatgactggatatgaagataggtggcatcgtcgatcagaaacaaagcctcctgctggttggcgtccacccccagcacttccatttccggcatggccgcagccagttcctttaccgctttctgtaccagcggattatcacggtaatagtcgattgcctgaatggtgtccaggtcaatggtctgcccggtcaaaatcggaaacggtccttcatagtcgcttccatctttcagctcaaagccaatgcccttgatcccgttcattcgctctgctggaatctcctgataaatgcggattgcttcctccaaagacaggttatcgtggtattctccgaggtttggaaattccatgcactctgctacatagtaggtcagatcgccggtcggcagcctatcagataccttaattgcgtctgctggctgctctatcggggcggtttccggctctacctttgcatgagggtcgattccgcgctctttgcagatttccttatagtggcactcaatgtcggagatcaaagtgccggaggttttgttgatggtctccaaactgactctcagctctttcagctctttgccctggctccagcttgcaatatagccgaagctgttttctccggtctcgatgccaaaatacttgcagaccgcataggagatgctttcagcctccacttcctccgtgtggcggtttttgattgcctgtttttctgcggttggatcttcctcaactgcaagacgccattcaaactgattttcgtccacataacgccaatccatatcagaagcaaactgttcggcttctttttctgtggcaaaatccaacttgaaatcatgtttggttccaccttcactctcctgcacaaccttccatgacggtagcatttcatattttttagggtcatggagcttgctgtgggcaatctcgtgtactgtggctgaaaccgtctgaacctcactcatgccctgacgaatggcaattttctgatgatcagcagaaaaatagccgtccgtatcagcggccattgcttcaaaagtaatcggcaccggtgcgctgcggcgcagggcctccatgaatgcctcataatttggcacattgccggaaagggatgatgcaagctccggcaaaggtttcccgtcggtctggctcacatcaaagaccttgaccggacgaaacatggggatctcgatttctttttcctctgtgacgatctttccgtctttatccaaaatcggagccttggtatccgggtccagcttctgctcctcgattttcttcttatacggtgtcggggcaatgatggtaatgccatgctctcccttttttacatgacgctcaaactggtctttccacttattgtatccggctaccaatgtggcgtccggcttctgcatatagatgagcatggtgttgtttaccgaatagcggtggaagcgggacatgacggacagatagcgcatatacttttcactctcaaacagttctttgatgccctgctcgatgccatctgtgatttcccttagccgttctcggttggtgggtttgttctcagccatgattttcaatctcctttccaagtgtgtgatttctgctgtgtgttccgcaatccatgccttttgttcttcttcactttcataaagaaaaaggtccagcaggtactctacataggctttcttctggattgcttccacaaagcgggggtgcggttcttcctccggtgtcctgggagaacggtcggcttcccattttttcaacagatagtagtaatcggacagtacgcgataacagcgctgtcgatcctcccgaaacttctgtgcctcggttttttgccggacatatctcctgcggggcggggcctggctgtcatagatcaggccaaagtcctgtgccagtttctccgccgcttcttttggggagaggttaaagagctttgcggtaaagtcgatcacatccccatctgcaccgcaaccaaagcagtggaaccgctggtctaccttcatgctggggttcttatcatcgtgaaagggacagcaggccataccatttcgtttgacctcgatcccataaaacgctgccgcttctctggtgctgaccgactgcttgaccgcttcaaatacattctctgccatgtgcctttaactgccggactttttcacagggggctggtatccggcggctttcgcacgctcactggcagctttgcgacgctcggcgctgtatggctcccggactgatacacaccgcttggggacggtaaagttatgggcgtcctttcgggtgatctggtcggggtgcttttttgccagcagttccagcttctccatcagacggggatcgtgggtatagacctcagccattggttctgcctggttatagaggagaatggtttcccgttccactaaagagagcttcatcggctgcctcctttccgctggtcaaattccagcttgaagttggcatactgtccatcgtcctccaaaaccacagtggcatcgtaggtcttgccggttttctccgaatatagccccgtcacacggacacggccatcgttcagcagcgcagacaccacagctttggtcggctgttttttcttggcagcccaccatttgttgttttcccagattgcaaatttacaagaatcattctgacagaagaagcctttttgcaattctgcaacttcaccgccgcagcgagggcatttgcccaccacctcacggggcggagtgaacaggtactcggttcccttgatgacctgataagtccccaccagatctttcagcatggcactgataccgtctaaaaactcctccggggcaagctgcccgcgctcgatctcgcccaggcggtactcccactcggcagtcagaagcggcgattgcagttgttccggcagcactgtgatcagggaaactgcatcgtgggaagggagaagctgcaccgttttcctgctcttttttcgttccagaaaaccggcagataccagcttttccaaaataccggcacgggtggccggtgtccccagaccttttcgctcggcgtcctccggcatattctcttttccggcagtctccattgcggacaacaaggtatcctccgtaaagtgctgaggtggacttcttttaccttctttgacgattgccgcagaaatcgaaagggtctgtccttcggtcagctccggcagggctttctctgcgccctcttttttcgactctgcatccttcattttggcacggtaagcgtcctccagtgctttccatccgggatgcttcaccgtttttccttttgtggtaaactccccaccggcacacgctgcaatcacaacagtttccgaatagatatggggctgggctacggcgcacatcagacgcagggccaccagctccagcaccgctttttctcccgcaggaagggcagaaaggtctgcatccttgagatttctggtagggattactgcatgatggtcggttactttcttatcgttgatgaccgtatgcggatcacaggtaatggcgatttctttgcaaaacggcatggcgttggcaaccaggttcaccaacaccggcaggctgtctgccatatcgccagtcagatagcggctgtcagtacggggatatgtgcatagcttcttttcatacaggctttgcagatagtccagggtctgctgggctgtaaatccaagcaggcggttggcatctctttgcagagtagtcaggtcatagagggcaggcggcttttcggacttttccttgcactccacctttttgattgtgacatttgcaccctgacaggcttctttcagctgctcagcagcaactttatccgccatgcgctccccggatacggtaagaccgggcagctccagcgccacggtataaaagggaatcggctgaaaggtgtcgatctcagcttctcgctgaacaataagcgccaacgtcggggacatcacgcgcccgatgttgagggttcggtgatacagcacggaaaaaagccttgtcgcattgatccccaccagccagtcggccttggcacggcagagggcagcatcccgaagtccgtcataatccgcaccggggcgcagatttgcaaagccttcccttatggcagagtcctccatcgaagaaatccagagccttttcatcggcttttgacagtctgccagctcatagacgctgcggaagatcagctcaccctcgcgtccggcatcgcaggcatttaccacctccgtcacatccggggcgttcatcagctttttcagaatatcaaactgctttttcttatcctttcccactaccatctgccaatgttccggcaggataggcaggtcatcatatcgccacttggcatacttggggtcatagctgtctgcatctgcaagaccggccagatgacccacgcaccagctgacacgccagccgttaccctccagatacccgtccttacggacggttgcgccgatcaccgccgccaaattctgggcaactgatggtttttcggcaattaccaatttatgttgagccatgatggttcctcctctctttgagccatcgggacatttcccggtgacagatacctacgcagggtcttccataattcccgcaaccatagcaggggtggctgtggggtaaagaaggaggacgggaagtttccttcccgccctccggcctgcgtgtcatcatgcgttcatagggactgtctgtgaaacgggtcatttcacactgtcctcatcatcttcttctgtgctgcccccgtcagcatccggttcttccgactcctcatcctcggtttcccattcctcggaatcttcctcgccataatcataatcgtccagactgtcattgcccttggtcttaggcttgttcttaacgagcttcaagtaggcaaatacgccaccgccaccaagcagagccagcaaaaggactatcgcagccgggttcaatccggcaggcttctccttttccggctccgatgtttctgccggaggttccggtgctttgcccgtacatttactcttatcagttgcgcagaccgggcaggccgtattgactgcccctgcttcacattttgttgaacagctacacacagcagccggctcctctttgacattttcatcttccatcagtgccatcaaatccgcttcatccacctggttcagaaagtgaacagcagtctttttatcctcattagccctgtcgatcaaaatgtaaaaatagttgccagccttggtggtaacggtaatgagctgcttattgccaccaaaatcatccaccagagcggcattgccatctggtgtaagtgccggtgccggttctgtttcttccacaatcacattgctgtcattggtagaatcctctgccggtgccgccggagcctgttctgacccctgtgcgaaagcagggatcgtaaagccaaatgccacaaccattgtcaggcaaagggcggaaagtgttttgcaaattcttttattcttcataagcggtagcctcctgattatttgattccgacagtgctgtatctctgccgtggttcattccaccggaaagcatagcgttcagctgtgctggagtcatgcgtagcgcacgaaccatctgaacgatttccagattctctgcctccgttttctgtgcttccagggtcttgagcttttcctgatattccgcaatcttctcacgggttttctcaatttcctggtcgatacgttcaattttgttttttgccataaccgttcactcctttccacaaagtctgttaccagttcatcagaccatagcctttaatgctttgataattcaggtcataacttttgatcttgcaggcatcgccggaatttccctccacggtataaacgcggctgccatccgtaccgatcacgatacccacatggtctgctgtcccatccaaatcccaatcaaagaaaattgcatctccgggagccagattgttatagcctcttgcaccccattgtccatgagactgaaaccacggaacgccctgccactcgcagcctgcaaagcgcggctcactttttccagcctggttataacaccaggatacaaagcaggcgcaccactccacgcggctgtcaaagccataccagctccaataaggatagccgcccacattgccgacctgacgcttggccaactccaccaactgcggatttccgggacgggttccatttacaaactgtacaccggtcaagtcctcggaattgctcatgtcaggggaaccaccgccaaacaacagcggcttattgcccatggtctgccggtaaacctgatacatttccatctgctccggggtcagtaactccgacgccacagcggaaatgggtttgctggtgagtttcacattcaaaatgtaatactcataggggacttcttctgaggtggtctcgccggtctccgggtcggtggaggtctccgtgcggtagcgaatctccacttcctcagtaagcgtcagctgatactgtgctgcaaacacacgcgccagctctgtctgagcgctctgccgggtgtaaccttgcaagacggcagacagaaatgctgccagctcatgagggtcatggccgatcataccaaggtcatagcgatactcgtcataccctgggtggctgttttcaatgttgtcgatttcctcctgcaactggacttctctggctgcataatctgcctccactgccagcatttccgggtcatccgacggataggtggtgccggagagaacggaaccgatgctctgcgccatcatggagcaggaggacatggtattcatcagcatacaggtaatgaggaacaaaacccctgccatcaggaaacccttcttgtggcgcatgacgaatgcccctgcctgctgtaccttttcttttaccgtccttgcggcttttccggttttggatgcagcctgggcggtatttccggcagtctgaccggcgtgtttggcggcggcatactgctttttgatggcctgcttttgctgccagcgggaaagagggttgctggcaaactggggattttcctgcaaagatttctggtacagaacatttacatttgccttttccagttgacgctctgcctgggctgctttgcggtacggcttcagcttgtggctgcgatagccctcccgcaccagataagcgccagtctccaccgcttcctcggacttatgggcgctttccacgcccacgttgtcctgctctgtttcccggatctctttgtggagcttgcccacgaccagatggacgggagcttccctgactccttgagaaactttggaaggtggctttttcttgtcctcaaaggtcagcttcgaggtcttttttccggtatccgggtcaatgaccgtctgcctgacctttttctttgggatattggcctgcgccttatctgctctggccgcagctttctccgctttacggattggcttttccagtgcagggtcagaccgttcctcatcagtaaagcgcaggcgcggctccttattcaaaccattctcccagcatgagggaggacatcatgtagtgcagctctgcataaatggccattcccacaggatcgttgaacatacagccggacaggtaggcataaaactgtgccaccacatcggacaggatcttcgcttcggttccttccagaaccagacctcccataccttccttggcacggatggtgctccagacctctgccagacggagcagccccacctgaccggtctcattcagttcggctgcttggtctgccgccgtgcggcactcgctgaccgcatcggccataaccgtaagcagctggctgcgctgggcatttaccgccctgtcaaaaaacatcaacgggttttgattcaaaatgctggggttcatcatcattcatcctccttctttttcagttcctggggtttggtggtcataatgcggtacagctcggtattcttcgggaagtggtccacgaaaggcagaattgtggagccatagaacagcaggccctcgccctcaccggagtgagtcacatagctaagctggtgtgtggaaatgcccagctgcttggcaagtatctgacggtctccgcctgcctggttgagcatatacacgaagtcggagttttcaaagatgttctctacctcgcggctgctcaaaaggtctttgacattctgggtaatacctgtcggaataccgccccatttacggaatcgcttccagatttccaccgtataggcggcggtctgctcctccttcaaaagcaggtgcatctcgtcgatgtagtaacgggtggacttgtgggcggcacggttaatggtaacgcggttccacacctgatcctgtaccaccagcataccgattttcttgagctgcttacccagttccttgatgtcatagcagacaatgcggttgttgatgtccacattgctctggtgattgaacacattgagggagccggttacatagatttcaagggccgtagcgatatactgggcttccttttcctcctgttcccgaagcaggttatataggtcctccaaaaccggcatattctccgggcgcgggtcattgaggtaagtctgatagaccaggcgcacacagcggtcaataatggttttctgcaccggctgcaagccctccttaccgcccacgatcagctcacacaagctgaggataaagtcagacttgagggacagcgggctttcatcatccgagtagtccaggttcaggtccatcggattgatgtagttggcagaggtaggcgagatcttgatgacctgcccatgcagacgctcaacaagaggtgcgtactccgcttccgggtcacagataatgacatcatcactggtaagcaaaaagcagttggcgatttctcgttttgcgctgaaggacttaccggaacccggcgtacccaaaatcaagccgttggggtttttcaacagctttcgatccaccatgatgaggttgttggatagagcattgatgccgtagtacagagcttctttgccgttctggaataattcctgtgtggtgaacggtacaaagatagccgtagaactggtggtcagtcctcgctggatctcgatctgattgagtcccaggggcagacaactcatcagcccttcttcctgctggaagtccagcctggtcagctgacagttatacttctgggcaatggagcctgcctggaaaatgttgttgccaagctgacggggattgtccgctgtgttcagcaccagaaaggtcaaaaggaacattctctcgttgcggctctgcaaatcctgcaagagttttttcgcttcactgccgtaggtagcaaggtcggatggaatgatgtccatgtcgtatccggcacgaactgcttttttctgttcctcgatcttactgcggtccaggtcggtaatcttgcgctttaccgtcttaatggctttcacctgatccaccgactgaatgtgcatactcacaatgagcgagctttccatatccaaaaaatcagccagcagacggtcattcagctccggtgcgagaatctgcaaaaaagaaacagccccgtatttcttgcccatacggaactgcttgccggtgcggaactcaaaggaacttggtgcaataaaatcctttgtggacagaccggaaggggccagccagtcccattcaaactgaaacgggagctgttcatccatgtggaataccgcatgaagctgagaaagcctttccttaccgtccagcgttctggcagctacaccaagacgcttgaagttattaagtatatcggtctcaatacgctccagacggggcttggcagctttgatgctgtctgcgtcgataccaaaagtcaggtatttggtcttgatgagaccgttgttacctctggccagctgattttgcagcattgtggtgtattcctcgcggatactgtcaaaggcatccctctggggcgggatggaaatggagttagcaaaggtctcctccgatgccgcaaggttcaaaaaagacagctggaaatgaatcgagctgtcaaaataattgaggaaatcacaccaaccctcaaagattgccgtcttatcttcgttttgggagagctgatagttgatgtcctgaaactggatggtctttgtgtagtggctgtccaatatgcggcagattccgtccggccacatccgttcataagggatactgtcctgcgcagattttccttttttgtccgtgcggttggcacgggcaatggccgcttcgatctgcttcttatcggcgcgggacagctttttctttgtctttaccagctgcaccgttttttcctcggtttttccgaacatccgatgcagccatttttttattgcggtgaacaatgtcatacacctccttatcgagcatttcctgccgctttaatacggcataaaagttattggtctggtagggacgctgcttgggacggatcacagctactttgagaatgttgcccacgatcttttccaggggctgtccatgcttttcgtacatagccagcataaagaagggcagcataaccagcatcatacacatagccgctacactgtttccggtaggttttctgagcaaaaagaaaagcggtacgccaataagcgctccgcccgtaaaacagataagctgccgcttggtcagattgaacatgacctttgttttgacttttgttaagtccttgggtacgggtacataagccaatgtggaaacctccttccgttttaatgcgcctgaaagactgatttggcgagactgccggttttgaacagcgtaaaacatagcagtacggtgtagcccacgcagctccagattgccatgatgatgtcatcttccagagcgatgttctgcaccagcacagcataaattgccacgcagacgataatgagaaacgcctgaaagcccagcgccagcagggatcggaggtaattctgtcccataccgccccattctttacccatcatcgcagccattggaacgggagccaccgaagtcacaaggtagatctcgatcatacggccataaataacgataaagatacagatatacaacgcccacatggtaatgccaataaagagggattggaaccacagtccgaacagcggtcccaaatccatttccatcagcctcggttccaggtcggtcataactgaggaaatgtcaatggacgcatccgaattgataatccctgccgcctgcgccaccacgctctgcgccatatcaaagacgcccatcacgatattccatgtgtttgtgacaatgaggatggcggcagctgatttgaacacccacttgaaaatcatccaggtatccacatcatgcaggttgttcttgtctgcaatcatctggatcaggtctacggtcatcacgatagccaggatcacgcctgcaatcggcaccatgatggagttggacagattctcaatcatattgaaaatactgccattccatccctgtggggtctgtcctacctgtacggatatatccgcgacctgttggtttacgctgtcaaacatccccgaaaggttgctcataataccgcccaccagcatttctttcagccaatttgtcagggcttcaagtaagaaatccatacggtgtcaacctcctttccgccgcccccgcaaagctgcgggagcggcaaggatttcatacggagacgcttagacagagaaaagcccggagagcagaggtacaaggaccatgcctaccacggctacaccagcaccggccatgagctgcttcatgccctgagattttactgatgtgtgataaagaagtaatagaagtgtaaaaaattttgccgttcctatccggcacatgaggtatgtcggataggtcgggcggttattcgggcaagtccaccttgccaacaaaagaataataaatctcaatgtcctgcctacgggtcttgttctcgtcatagctgcactcatgcacaacgattttctctacaaactcccgcaacagagtaggggtaagttcttcaaagctggtatgccgccggacaacattcataaacttttctgcgttcacggtggcttcctgtgctttggaaagctccgcttggatagcagcggctctttctttcagctcccgttgttctgcttcatagtctgccgacagctctgtgaaacgctcgtctgatatgcgcccggtcacgctgtcctcatacagccgcttgaagatagcggataactcggctatgcgtttctcggcggcttccagttcatttttcttagcggcgttcctgcgcttgcccccgtcctcgttctgctcaatcaagagcttcataaaccgagcttcatgctttgccgcatagcttgtcactttccgcagattggagagtacgccagcggtcaagaggtcggtgcggataaagtgcgccgtacagtcatgggtgcgtttcttgtagttgccgcagatataacagtcctgcttgcgcttgtccgtctggtatcgctgctgatacatgacactgccgcagtccgcacagaacagtatgccggagaacaagcccacttcatcatagcggttcggacgcttgcgctgtttgcgtaattcctgcacacgctcccatgtctgggtgtcaatgataggctcatggtggttctcgaaaattgcctgtttctcaatgggattttctacgctgtgtttggtcttgtaggacggtttctccgtcttgaagttcaccagacagcccatgtactcccgattttcaaggatatgcaccacagtatttgtcgcccatttgcattcatagccggggtgatagcggcgtgtgctgcccgtcctgcggtattccagcgtccccggcgtggggatttgctgctctgtgagcatacgggctatcttggtcggaccattcccggcaaggcagaggttgtatatctgcttgactacgggtgcggcttcctcgtcaataatgaaattttcgtcctcgtccatgaggtagccatacacaggcttgcttgtgatgggcttgccactcatgccttttgagcgttttactgctttgattttcttgctcgtatctctcaccagccattcgttaaagatattccgcagcggggcaaagtcattgtcgccctgtgcgctgtccactccgtcattgatagcgatgaagcggacacctttctgtgggaaaatcatttccgtgtacattcccacttgcaggtagtttcgccctaacctcgacatatcctttacgataacggtagccactttcccggcttcaatgtccgcaagcatggattgaaaacccggtctttggaagttcgcaccagaatagccatcgtccgtgtaccagcgcagattggaaaaaccgttctgctttgcgtaggtttcaagaatacgcttctggttggaaatggaattgctttcgccttgcagctcgtcctcatgggatagtcttggataaagggcagtgattttctgggtggtctgtcttaacataaaatcctccgtttccgacagccagccccactattccgtaccttgattgtaccacatggggcggctgtctgtatagcggcaaaagcgtcaaatctgcttctttatggtcggtcaaatcgctgttttttgtgtagcagcttccgcttccagcactttcatcatcttgtcggctgcggtatcggttgcgccctgcttgaagaagccggaaacggtaaggacggagttgcccatgcggatttccgttacacagtccggacggcggtctgttttggtggtgcttgtctgtttcgtttctgtcataggctctcctttcgctgcttcatcagttgctttaatcgttccagcttttcctgtgcggtttcctttcggaaattgctgcccgtgaagcggacgggggcgcacatagaaagcagcctgtcatagatacgggcgtggggcgtgtcctgcgggtgctgcaattcctccagcgtgaggttggtcgtggcgatcagcggcttgccacttcggtaacggctgtcaatcacgctgtaaacctgttccagcccgtattccgtccctcgctccataccaaaatcatcaagtatcagcagggggtagctgcaaaggtgggaaatatactcattcctgccctcaaagctggcggcaaggtcattcagtatcgttgcaaagtttgtcatgcacaccgggacttcctgctccataagggcgttggcgatacaggcggcaaggtagctttttcctgtccccacgcctccccaaaacaggtagccgatattttcagcctgcatggtttcccagctctccacataaaagcgggcggtttcggtctgtgggtttctgccgttgtcatgctcaaatgtccagttccgcatagcggggtcggcaaagccccggcgtttcaagtcctccactgtttcaaggtgcttctgtcggctttcggcggcttgctgcttttcacgggctgcccgctggcagtcgcagtctgttgggtgtcggtcatgccctaaccattgggcggtttcttttgaaaagtaggcttctttgggcgtatggcacttgccgcagtataaaagcccgtcctcgcctgtgtagtcctccgcttcggcggtagtggttgtaatatccgtaatcatagcttcaatctcgtttttcataagctctcgccctccttacatgaataatcgggtatgccctgtttcggggcagccttgcctttggcagcgtcctcctgcgcccacttgtaaatggtggctgcatggctgtggtactgcttcccggtggaagcgatatggcaggaaagccggtcaatataatactcccacttgtcgggcagctctgttttcagcccggaaagctctgtatcggtcagtatcacattgttgtatctgccataagcggcgggggcggggtgtcccgtttctccctctctctctttttctatctctttctctaactctatctctatctctggtggacgaatgtcggacaaatgtccgccttttgtccggggcggtaaaagtgccttgttttccagccttgcagcccgttttctctcggcttcggtagaggactgtcctatcatcagctcaatatcggtcatataaaaagccccgctgtcaagctgctccacaagccccaactgccggaaaatctctaaagccctttcaaccgtccctatctggtggcgggtcagtgtcgctatcatctgcgctgtgtaggggatatgctcgtcaagctgcaacttcccgccgtttttcagagattttaagtacagcttcaagaggatattggaatataaaatcccgtctttcatatcttccagcagcacaatggagtcgctgtcaaaaaaattctctttcagcttgaggtagtaatacttgcggttatctgccattgtccctgtcctcctttttccggcgtttggagtagtagcgggggcaaagtatgataaccgcccggaagctctgcttacagctatgggtacagccccggcagaggtcgttgtatgtgatacggtcgcaggtggtattcccgacttttacttgccgcaggaaaaaagaccattccagccgccgtttcttgctcattcttggcatgggtgcgctcctttctgccgtttccgctggtgtggcggtatcgacggtaattctgtatcatctcggtatcattttcggggtttttctgccctgtaagcccgttaaaaaatcctttggtattgcgggtagagtacggggcagcccccttgttctgtatgggttcgggtacattttggggtggtttttatcgttcctgttcctgccttttcacaggcttgcgctcccggcgtaaaatctggtcgatattgcccttgacagtctgtaagcggcggtattcctcccgttttgcccggtaatcgttgtagccgctgtttttctctttgataaggctttcaatctctgcttgcaaggctttatagcccggcagcttggaaatgccgttctccctgaaataacgggcggctgcgtctgctatgataaagtcgctttcgtgcttctgtcggtaggctgcttttgctttggcgtttttctgctgtttcagcccgtcccggacagggcgggtcttggaataggcaagtacctgccgttgcagctcctttttcctgttcagcgtcttttccacctgcttcagctctgtaaggctttcctgcatggcggcataggcggcagaacaggcttcgtccagttcctccggggaggaaaagccgtactgctggtaggcggtaacggtagccgccatctgctttaggttgtgctttgccgcccagcggtcatagcccacgcccttgccctcggctcgcttggcttcccggtcaaccatgcgctgcaaggtgttgtctgccggggcggtttttgcggttttttcctcctgcaagcgtcccttttgggtatgtgggtattccggtatggctttaggcttttcggcggctctgtgggcgttctgcgtgagcagggcaaggacagcagccttgtcaaaatcgtcccccagcttccgggctgtgataggctttgttctgtccggcgtgaggtaggaaagccgcccccggctctccttgacggtcacgccctcccgcagcaaaagggaagaaaactcgtcaaagctggtagcttgggaaagtgcctgccgtatcgtccggcgcagcttcgccttgtccgtttcaaacttggtgggcttggtcggttgtccggcggcttctctggcggcgttctctttatcaagggcaagctgccctttctttgccgcccagtattcccgttctgttatccgttccttgctgccgttcaagaggtcgatttggtaaagcccctcccggtggcacatctccataacttcactcttgaaatattccatagcggcgttggtacagcggtgcttgcagccctcccgtgtgtcggctggtctgtccatgtagggcagaagcgggacttcataaatccgcagggagttgaggacgatatgcacatggatattcccgctgtggttatgcccgtccgggtgggtgcatacaagggcttggtgtccggggaaatgctctttacagaactgctcgcccagctcctgcgcccggtctacggtcaagccgttgtctgtcccgtcccgtgggtcaaagctgatgatatagtggtggcttttcacatcttcccgtttttggtttttctcatagcggagattggctcgcatacaggcaacggcgaaatcctcgcccccgcagttaagggaagaaatgcggtagtcctccctcggtatcagccgcccgttttcatcaagggtgggcttcatggtaaactcgtcatgctcaaatgtgaggtaggcttccgctgcgccatagtcggcatttttagagctgatatgtttgaatgttgccaacagcatcacccactttctgcaagacttcaaactttagggcagcaaggtcggaaaccgccgcccgtacttccccggcaagctgcgggtagggactgtgccactcgttcagcgtccgggctatctggtttaagttgccgccgatcctgccgtattcggcggtcagcttcccgacagcggcaagcagctcgtcattgacgggggaaacggttatgatggggcgtatggctgccccggttatggcttgccggataaactcggcttggctcatgttgcaggcagaaagcctttccgcaaactcggcgtattcttcctcggtcatgcgtgtcttgactacccggctgcggtgcggcgtgttgtatcgttttcgcatggtaaaaacctcctttcggctgccgcatggctgcggcgggataagcggcgtaagccgcataagcagggtttggggaaggcactccccaacaagattcccgcaggggcaaaatgagcgaaaagcgaattttggtactgcggtagaatcttgctctaagaaaacggcgaaactccccctttactccttactacgcagagaaatgcaaatatggcaaagttttgaaaaactttttgataaaacttttcgacaaagctggaaaatcagcgcggtttttggcgcaaaaaaacaggaaaccttttctgatttcctgtcatggtatgccgctgtaacgggcggcggttattctgttgtcattccccggaagcaaacttgtagcccatacctaaaacggtttttatgtaaatgggcttgcggctgtccggctctatttttttccgcaggttgtaaatcacatttgcaacgcttgactggcagctttcactttccatgttccaaacggcttcaaatatttgtgtccgtgtgaggacaatgccggggttggaagcaagatatacaagggtactgtattcaaggcgggtaaggcttacttcctccccgtcttgaaatacccggcgttggttctgctttatttccagtcccggaaaagataacacggaagcggttgtgatctgcatgggttcaatctgtatataatcagatattgccgatatgattttgtcaatcgctgtttcctcttgttcgttaagtgtcagcagtagtaatttccccatgttcattacctcttttatccgttgaatttaaactatatttttctgtcgtgtttttgacagtaagcaacaaatatatatgatagagagcgtaatgtcaatttaatgccattaaaagagaaagatggtctgtctaattattatcattttgttcatatgcacttacgctgcgtttggcatttaggcaattcaatatattgtaaatttatctatatcagcgggctaacctcattttcacaaaataagctaagtttgtgaagcgctcttgtgcaggcaacatataagaggtttttatcatcttcatcatggtagttttggctatctgcatcacaaattaagacagtatcaaattctaatccctttgacatatatactggtaagataaacacgccttgtaaatctgatacgctcccatttttaattaattgaatatcaagtttgtgtttaattttattaaatagataggttgaatttttttcggttttacaaattaagcatatcgactgaaaccctttctcttggcataattttatttccttaacaatttcatcaatgaagatttcggaattatcagcaatatatacttttgggctatcgccattccgattaaaactttttatctgtgaactttgttcaatgaactttaaactaaaatttaaaatttcattcgtacaacggaaacttttatccaacataataagagaagattttttcttgttcaatattttttgaatttgttcgtagaaagaaatatcttcttttttggcaagagtctgtttcatatctcctaaaatagtaaatttggcattagaaaaaagcaaattaaatatttcatattggagagggtagtagtcctgtgcttcatcaatgactacctgcttaatatttttatatttatttgttccgtatatttttaaatacaaataagcgattgctattgcgtcatcataatacaagctgtctgcttccaaattttccttagtatatttccaaatattttttatgttttgtgacggattgctattttgcagcaggctataaaaataggcttcattgctaaataatattttatataattcaacaatgtcaatttttataaatttctgtatttcctgcttgattagatttttttcttctttatgcccccgcccttttcctgttccaaatatttgttctaaaatataatcttctaattgttctaattttatgcctaatggtgtttctggtcttcctaatatcttgtcttttagaatttgcccgcttacaacgcattttccctcataataaacatcttcaaattctatccactggcggggtatatcaatgagaaattggtctaaaatttccctaaaaaaacttgacgttttaaattctatactatttcttgaaatttccttgtattttgaattgacaatcaagttttctaaaaaatcatttcttgactgaattttcctgccatttaataactcactaagtatatcttcaaacacggaagaaataacattatcttctcccaattcgggcaatacatttgaaatatattgctcaaatatagaatttggggaaataatcataatgttatttgcggacagctttgtttgtaaaccttgatacataagataagcagcccggtggagagcaatagaggtttttccacttcccgctacaccctgtaccattagcaggtcattttccatatctctaataaccacgtcctgttcatgctgaattgtttcaacaatagctttcattttagcagtagtgttttgtgacagtaattgccttaaaaattcatcaacaatctgaacatctgaatcaaaaaaatattccagtattccgttttttatttcatattggcgtttcaaattgagttcacctgttactcgtccacatggagcgtcataaaacgcttcgcctgtcataaaacgatagaaaacactggcaatcggcgatctccaatcataaacatacatctcttgatagctgttttttcgtagagaagaacgtccaatgtatattttttcgaattcgtcctcatcatcaaatttaaaatcaattcgggcaaaatagggcgattttatcatcttttctaacagaagtattttatgttcttcttcttcataatctataattttgtctgtaacaggattgatatattggcttaattcaacaagtgcctcgaaaccgtctgatgtgtacagtgatgtaatgccgtgttctgtattttcacgcacatcttttttggcttcgataatttctgatttctttttgtctgccgcttcttttgcctgctttaattgttcctcggctaaagagattgtttgtgctaatcttttttcttcaaacgctttttctgtctgattattccccataatgattatgacctccttgaaaaatgaaagaaagttttactgaaacattgctaggctagtttagcatgtgtcagcttatataaacagtcttgtatttataaaatttgtatggtattattatagtgggaagaagtatgttagatatttgatttctgcaagcatatcaattctaatacggacgtgtaatttaagcaataaacaaattgggacaaagcagttataccgctatgtcccaatttgctattactccatatcttcagcagacagaaacacaagcccgacaaattcttcctcaatcagtttcttcaacttttccactgtgctctatgcaggctcccgtatctccattccaacctataatctctttctgtaaaagcaaatcttgttctgtgaaaaaatgagttggattccgtagtagtcggcattgtgcgtaatgtgtataactgactgtatcatggaattgtgggtaactctgtttgcaggacgtgggaaagctgcactttagcttttccatgtgctgtgaatagagttatccatgattccatagcctgttatgcacatttccacaatgtttgtcttttggtcgttggttcggaaaagaaaagccctgtatgttattatatacagagccattctaatctttttttatccactacatagagcgtttcctttctgcaaaattcattttacagagtgatacccgccttttttgcaaagtagtcttttctcccggtaagctctgactgtttttcctttggaagattgttgaataaatcatcataaagaacatcagctaactgcatttctctcgcaagcaaaaatacatttagactaagccattcctcccaaagcccctcaaataagctgttactgtctgtataggtgtcaagctcctcaaagccatgtgacgctgtatagcattgcagtttaacaaagccatacctaccaacatcaaccaacaaaatatcttcgtcctctatttcgtacagttcctcaaacacatcaatcactttgcgacacttttcccgttcttcctctgtgatatatactgttttttccatgctcaattacctctatcctttcaaattgtggaatactgttttcagttttcttctacttctgaaccacatatttgaaatgccatatatgccattttatacggaatagaggttggctgtctgcatttatcagtgtgttactttatggcacatgagcattggcgccggggttgtcgttgccgtaaccttccagcaggttgatgacgccccagataccaagaccggcaccgagcgcgataacgagggtctgaagaacggtgattgcctgttcaaaaaatgccatatagtttgttagccggaatctgattaaaaaataggtttgtcatgtttcataggcatacaaaagccggaacaatctgccacccggtttccgggggcatgattccggctgtcctcctttttcattattttttcttgcgattgtccgctttgtacgccaatggcccatagagggcaggtgcggcgaatagataagatcactcccttctaaagcggaacgaaattaagcgccctttgtgtctacttcatatacatcgcagacctcattgggcttgagtttcagccttgcagacaagaatgcttcaatatcaaaagcgttcttgtcatccgcgtcggcagtgtacttgaaattggggtgcttggtgatgtcgtacttatccgaaaggaaaggacgcacaccgcgcagctggaggatacacttgccgccatccataacagcaagctcatcctggctcatcagctcttttcccaatttttgatagttgagagagtgggaagtttcccggccacggctctctccggtgttgtaggtgtcgatggtttccttgcccagcacggcagccagctctttgagggtagtcggctctttaccacccaggaagatggaagtatccatgtttccgataatggtatctgcgttatccttatagatcgccttgagctgactctgcgcctgcaacaccagacaggctgagatctcacggcttcggatcgtggccaccaacttttccagcttcggaatctgcccgatgttggcgcactcgtcaatgagacagcgcacatggactgggagcctgccgccatacacatcgtcggctttttcgcagagcagattaaacagctgggtataacacatggagatcaggaagttaaagctatcatctgtatcactcataatgaggaacagagcagttttccggtctcccagagtatccagttccagctcgtcataagctgtgacctcgcgcaactctgcaatatcaaatacggcaaggcgcgcaccgcaggaaatcaaaatcgacttagcggtcttgccggcggccagcttatatttcttatactggcgcaccgcaaagtgatttggcttctcggcttccagtgcatcaaacatcaggtctacggggtttttgaactcctcgtcatcctccctgacttccatcgcattgatgaactcaatgagggtggagaagttctgctcctccaccggagcctcatagtggatatagccaatgagcgcgcagtacaacagcgtctccgcttatagtgataggtaatcctttgaagttatcgccggattttcccccactccacaccggacgtgcgactttcaccgcatccggcgttccatcggttgttttcacaagcatttaatcaatcaccaaatgaaatgttagttttctattgcggacaaaccagcctgctggcgcagactgttcacttttaacatcagttcctttgttgccttgagcgtgtcggctatctcttttagctcattcttaggacactcttgcaggagtggaagaaatctattatggaacaaaatcatatttcgatagcgttccttgccgcccaattctgccggtgttttcagccagcatactatgtcagccgcattttcaaagagttccccacttagcgcacattttccacgttgagccgagaatagtgaaatcctgctgtcagtaagttctgtgcttcgccccatagacggttgattcctcaaacctgatagaacagatgagttcatacttaggttcgtgtgtatcaatgcccgtccctctaccgtgtaactgcaaaccgccgctttctttgccatcggtatcttgttcttgatgtatgcgatagggtagataggttggtcgattccagatacataccgtatcattgccgactttccaaaccgttctttttcgctctcggtcattgcgccgccctctcgaacaagtctgcacccggtttctgtattgagccgatttgttaaaactgtcatgacctgtctgtggattttcctgcaatcaatgctgatgcaggtggcaagttgaaaataattctgtattcccagaaccattgaattgtacagccgtatttcgtccaaaggtctttttccctctgaaggtcgggcaattcgtttcgcctgttccaccagtttttgcctttccagttccaactttttgtcacagatatgagattgcacgatgtacttcctgtttttcggtctgactcgtatcttaaacccaagaaactctgaatagcgttttctaacattgactatccttgttttctctggcgatacctccaacctcagcctctcggttatccatgccgttacagcctctttcgttctcaaagcgtcctctttattccggcagaaaattctgaaatcatctgcatatctcacgatatacatttctttcaaccctgttttcctcattttgaggaatgccttgctccggtcaaaagtaatcgagtttctgattttcctctcatacccgtattcctttacaagagggtggttctgccattggctctcaacccatttgtccagttcattcagcacgatattggcaagcaacggtgaaatgataccgccttgcggagtgcctttgtctggaatgagtgtagtgccgtctggcattctaatcggtgctttcagaatccgcttgataataaaaatcaactgcttgtcgtgtattcccattgcccatatttgccgcattagcttgctgtgatttacgttgtcgaaaaatccttttatatcaaactcaatcacataatgcaggttcatgcgttgaagcatggtgtaagttttctgcacggcgtgttccacggaacggttcgggcgaaagccgtaactgttgtcgctgaatttcgcttcgcagattggctctatgacctgtttgatacattgctgtaccagcctgtcccagatacagggaatacctaacggtctggtttttccgtttggtttcggaatgtctttgcgtcttaccggctttgggcggtatccgtgctgacttcctgtgacaataaacctcactttctctgcaactgtttcgggcggtaaacacccgatgtcactgatgtttttgttgtctgttcctgctgtgtagcttcctccgtttgctttgatgttccgatatgccagaagaatgttgtcccggctcagaattaaatccataaggtcggtaaaattttctccctccaaacttcgatgatagagttcatcaaaaactggctgcataccgtaatactcggcatgacgtaagtcatctacacatagagttttgtttttctttggcataaggcatcacctcctttttgcgaaagtgacccttttggtcttactcgaatccttatgttggattgaataatgcctgcttatctcaatcgacttgtggccattcctccgtagctcacataacgcaagcacatcataggttcgaccactacttttcagcagcagttcgtctgcttattgtttttcgtcagactattccttgcggaatctgctgcctttcctcgttccgatagttctatctgttcatacatacccgtaggttcctgctatagacctgtcggcttgcctgtgcctgtaacacagcatggtcgttcgtaggatcaatttctactaaaccacaccgactgcgcattaacgcacccacacatttctgcgtggtcttcttttagacctgtacattcgcaggttcgtcagtccgcccgccaaagcgaacattctaaccataggtatcttatagactctcggcttataggtaacacagtctgcctccagaccgctttcgaccactttaggcagtggttacggttactctcagcctttgtcatggggcttcgtacaccagccattacagctaatgcacgcccatcaagggtaggcgtttcagggcgttaccccgtcattccacctatcaaactaccagttctccgaacaacggaaaaccgttgctcgtgcgcagactttttaccgtctgcgaacgagtcgcactgacccagaaatcgtcgccagccttgccttcgcctttggtattggcaatcagcgtcgtaaccagcttcaagatgtccttttcgctgtgaatgtacgagaaaggattgtagtgcatactttttttgaagttgatggtattcaacaccttaatccggtatggctcatagattacctttccgtgcttgtccttcatgggctttccgtccttccccagcttgggcgcacccctttggagcatttttccgcactccaccagaattgttcccttcgggtccgtcacaacataggagctgtgcatctgcatcaggttgggtttcagccagaatcgggtcttaccggaaccggagccgccaatcaccagtacatttttgtttctggcagtcttggggtccttggggcggctgttcatggtcaggctctccgtttttgtcagaatcacattgttctgaaatacaggatcaacgtaaggtgcaatatcctcacgggttccccagcgggccgaaccatattccaaaccatgtcgatatttcttggcgttcttgcttttaagatacaccgccagcctcagaccaacaccgcagcacagccctaccaacaagtccaatggatgcaggcttggccagaaactttgcaacgccccaggcagaaccgcaaccagcgaaagaaacttttctgaagcatccgccccttgtgccattcgccatgcctctccaaaattggtagcaaacagccccagcaggatatacggcatattcagcaaaatgagctttttgatgtccaatgtctttttcatcgttccagctcctttcgcttggtgcgatccaccacagcatttttaaccatctctttgaactggttaagttttgccagtacggacgggcgctctgttttcgttgcctttttgacctttttgttggtgtactctgtaaaagctgctgtcagagcatctgcatcacggcctttgaaaaaaatcaggtactttggtggagaactgctgcgatcctttttcaccgcataatccacaccatatttccgggcgattttctcaaactccttgatagaggggtctgtgatctcaatgttggatattccctgattctgcccgacaagctgcttcacagtctgttttccatgcggaacaaccggcgcatcacggcttctctgtttttccagcttcttttccttgcgatgtgccatgtacttgcttatggcagccttaaacattctgccggtaaactttgttccactgacaaccagcgtcaaagttctgttttccacttcttcctgcattttctcgcctcctttccacgaagtttgcagggaatctctttttttgctaaggcggaaccaccagccgccgcagaagataacgcttcataccgccctccttagcgtaactggtcagaacggtcatagtgcagattgccctggcgtacctttgcgtggctcaaaatcttaatctgccccttttcctgactatccagtgctttttcataaccggtatccgacaggaacaggcgtgttcgttcgcctttccagccaacaggggaatcgttcgtcagcacatcaaaaataatcatgtgccgggtgtcctccgcaaaacgctggaggtccatatatccatgaccgtgataattctgcgctcctgcctttgcccgcatttcttccatcagctgccctatggtctttccctcagacatcatgcttactcctttctcccggcacttccgggcaataaaaatagcgaccatttaccagccgccatacagatcgtgatttacttgtgaggtgtaatgattgcttatcgtggtcggtgcattgaacagaacggtcagaagatactgcttcatgttacgaatttccgtggtgttcttctgtaaacagtccatgacaaactcaatgtgcgagttatccagcttcaagaatctggaacgaacgatttcatgcggaaaatcacttcctgcaatacgggttgtctttcgctttgcacagaccgtttccacgattagctccacaatctcatccaaatcctcccgataagtttcatactgctgacacaggtattcatacccgatattctcctgaatcaattcccgataactctctatctctgtgagtgacatcgcatcccttcctttccgttccggcagacaatctgccgcgcaatcccggaagggaatggaatcggtacttgatccataaatattttgtttttgagtatttgatttctctatatttaattctgcgggcttttccgtatccggtttatccatatacgggttttccgtatctggtgaatccgtatccggttttctaagctgtggctgctcgtatatgacatactctgtatcgctgatgcgtccctgccggtcacgcagcttgtgccgcacaatgtaaccggcagcctccaattcccgcaacgcagcgcctatggcatccacgccctccttacagatctttgcaagaccacgggtggtgtaattccagtcctctggcaaagacagcatcatggaaagcagccccttggcttttaacgacaggtttgcatttcgtaaatgatgattgctcatcacagtataatcacgggtccgttcaatgcgaaaaacggccatcgacctcactccttccgaattttgggtacaaaaaaaccgcaatcctcattccaaagaattgcggtgttcaacacttttcaaattttcttgcatagaaccaaaacagcggctttcgaggacgcgcctctgtaaatggctcctcctgggcgaaaggaagtgtttgcatcactcggtcaatatccgttgattccatgtcatgctgagatttgcaatcttcccggattgcttcttgaatttcctttaccgtacacatagtcattcctttcctttcgttgtatgggtttatgagcggcggcgttttcccggtttgaaatcgaggatatgtccctcaatcacacgagcgtaacgcttgatcttaatctcccgacgctgctggctttgcagggcagcctgatacccgtcctcggtcaaaaacagccgcatttcctctccggggctgccgtaagctgtgctgggacgcaggacggaaaactcaatcatccagcgggtgttatcccaaaacctctctacggcgagaattttgtgtcctttcagctcacgggctgaaatatccctcataggcggctcctttcatcgttcctggtctctctgacgctttttctgccatgcctccagcagcttgatgatggtttcctgcatccgctggggcgtatagcttttagggaaatacttccgcaaggtatcagaggtaaatgtcactcggtccagatcgcttttcttttcctctcccatgatgacacgcatcatatcgagggtcagatgcccctcctgactgtatttcttgagccgctgggcttgagaaagagaaggggtagcctgttcgctgtccatcgcgtccaacaggtctacctgttcctcctttttgagaaaggacagctcataggcgggatttaaggcaattttcttttcatccaccatgtccagcagttcgggaatcagctcagtcaagcgaataaatctctgaacctgcctttgactttctcctgcttgatttgcaaccagctgaattgatgtctgcgacttctcgccaacttggcgagaagttaaatctgagcgttctccctgatgttttatagcctccaacttcattttataggcaaaggccctctcacttggaagcaggctttctcgttgcaggttgctgtcaaccataataattgtggcagcgtcatcgtccagatcacggacaattaccggcatggtctctttttctgccagttcacttgctctgtgccgtctgtgtccggccaccagttcataaccaccctccgggtcagggcgggcaatcgcaggaaccagcacaccatactgcttgatactgtctgcggtttccagcattgcttcgtcatccttgactttgaatggatgccttttgaacgggtgcagttccgacagcgggatttctactactttttctctctgagcatcggcacggctctcctccgtagaaaacagatcatctaccgatgccagctctacttttttcgcgctgcttttcaagtttcaacacctccttcgtcagatttcgatacccctctgccaccttgccgccagggtcatgggcgaaaatactttttccctctgcgctgatttcctttgcacggacagagtgtggaatctccgttccaaagactttgattttacttccataggtgtcccgcagcaaagcagcaatctcttttgcaaagttggtgcggttatccaccatcgtcagcaggataccgtcaatctggagctttggattgatctgccgtttcaccttactgaccgtagatagaagctgttccagtcctttggcgggcagatactctgcctgcacgggaattatgatcctgttcgcagccgccagcgcattgaccgtaagcatccccaacgagggctgacagtcaatcaggatatgggagtattgccccttcagtgtgtccaggtattgccgtaaaatcgtttcacggctcatggcgtttaccagagaaacctccataccggaaagctgaatatccgcaggcatcaggtcaacgccttctgcatgatgcagaataccttctccggggcgtataggctgatccatcagaattttgcccattgcatccgacagtgtaactggcagcttgtccggttgcggatttcccaagctgattgtcaggcttccttgtgggtccccgtcgatcagaagcactttctttccggcctgtgccaaacctattcccaagttcgcacaggttgttgttttgccaacgccgcctttctggtttgcgatggcgatgatttgtgtgttcatgacttcacctcatttctgattgttgctgttgtttctggaaatagaaaaagccgccacttcaaaatcataaagtgacggccctttctaatgccggaatctctgaaacaaaaaaagcacccagttatttgttactgagtgcctgcattagaatcgtatttaattgttcagatttggtcagattatgccaaaccctccagcgaaaaatccggtgtctgagagtgccaaatcaccctcaaaaatacccccgaaattgctctctggttgtcctattttttaaccactaaggccgttttttgaccccatttttgccggttgtcctatatttaaccactaaaaattgggtgaaaacggctctcgtttggtcaaatcaagtcaaactatatcagcccgtttaggtataagaaaaccccggaaaaccttgattttccggggtttttgaaccattttgatatagtctgagcagtcgattatcgcttgctgaactgcggagcgcgacgagctgctttgagacccggtttctttctttctttcattcttgggtcacgagttaagtaacctgcagattttaatactggtctgtattcagcgtctgcttcaagcagtgctctggagattccgtgacggattgcaccagcctgacctgtgaatccaccgccatgaacgtttactaatacgtcgaatttgtctgctgtttcagtagcaactaacggctggcgaacaacaactttaagtgtttctaatccgaagtattcgtcgatatctcttttattaattgtaattttacctgttcccggtactaagtaaacacgagctacagatgattttcttcttcctgttccatagaattttgtactagccaatgttctttacctcctattaaaatgttaatacttctggtttctgagctgcatggttgtgctctggtccagcgtatacgtgaagttttttaatcatgcttcttcctaaaggtccttttggaagcatacctttaacagcgagttcaagaaccttttccggttttttagccatcatttcttttaatgtggtttctttcattccaccaacatattctgagtgatgatagtaaattttctgatccatttttttaccggttacagctactttatcagcgttaacgatgattacataatcacctgtatctacatgaggagtataaactggtttgttttttcctcttaaaacttttgcaacttcagatgcaagacgacctaatgtctggccttcagcgtccactacataccattttctttcaatcttatccggattagccatataagtgttcatggttttacctccctaattttcaacatatcataatctgattacttcataaataaaatttatatgaaaatactataccggggcttttggctaagtattttcgcactacgtcacattgagatattatattatacttaccctttaatgtcaatctttttttaagaaatattacaacatgaaacgcaaaatctttcttgttcttttttctctcacgattctactccgattttcgggcagatatcatttaagcagcattgttcacaatgcggttttgttctcgccgaacagacttctcttccatgatataccagtctgtgacagaattcactgccttcttccggtggaataattttccaaagtgccatctccactttctttggctctttgattccatctacaagccccatgcggtttgtcaggcggatacaatgcgtatctgtgacaatcgccggctttccaaatacatcccccataatcaagtttgcactttttcttccgactccaggcagttttaataactcattaaaatcatccggaacttttccgttatatttttcttttaacatacgcatgcaggcactgatatctctcgacttgctttttccaagaccacatggtcttacaatttcctcaatctgctctggttctgcttttgcaagtgcatccacatccggatatttttcatataatttttctactacaatattcactcttgcatccgtacactgtgcagcaagacgcacgctgaccagaagtttccaggcttcattgtagtctaaagtacaatcagcatctgggtattcctctttcaatcgttttatgacttccaaagccatttcctgtttttccattgtattttctcccgattatcattataaagcggacattcgcatccccctcacccgccgcttagtgctctgcgcacttgaagcgtgggaatgcttatctgcgttcaactattttatcgcaagccgattaatctgtgttgcaagataacccgcaccatatccgttatcaatattgactgttgcaattccatttgcacaggaattaatcattgtaagaagtgccgataatccatgaaaacttgcgccatatcccacagaagtcggaacagcaatcaccggcacatctacgagaccaccaattacactcgcaagtgctccttccattccggcaaccgcaactacacaattcgcatcctgaatttctttaatattaaaaagcaaacgatggattccactgactcccacatcaaatactcgctctactttcgttccaaagtattctgccgtctgtgctgcttcttctgccactgcaatatctgctgttccggctgtacacactgcaaccagcccttttttttctcttttctttccatctatttttaaaattccggaaagcgggtcatattctgcagccggaaatttttcttttaccagctcatattggtgtacagaagcccttgtcccaaatacttctccgtttttttcatataactttcctacaatatgaagcaggtgttcatccgcttttccactacagaaaatcacttccgaaaagccggaacgaacttctctatgcatatccagtttcgcatatcccatttcttcaaacggctctctcttaaaataactttctgcttcttctattgatatttttcctgattttacctgttctaataattctcttgtttccatttctatttcgattgccctttctgactgtcaaataatttgaaacagctttattataagcatttcactaaaagaaagtcaatcttaatgtagtcgctcaaaaaagaagtacctgctcatttttgcaaatacttcttttttcaaaatttataccttttgatacggcattttctgatacataatttgttcaaattcctcgacaggcattggatgtgcaaaccagaacccctgtgcttcttcacatcctgctgttcttaacacatcaacctgttccagattttccacgccttcacagaccacacgataaccaagccctttcactactgcaacaatctgatgcagaaaatacattccacgttcacttgtcttacagttatccataaaaactttgtcaatttttaccgtattaaccggaatgtcaatcactgtgtttaaaagggaatagcctgagccaaaatcatccaatgcagtctgcatattgactttctgaaatctttcaaacaatcgttttacgttgtcataatacgataccgtcgctgtctctgtcagttcaatttcaagcaaagcagggttaattccataacgatttaaaatctccagataatgctcaacagtatcacaatctcttgcgtggaggattgaagcatttaccgaaatcggaatcaattttctgccctttttcttattttctgcaagaaactttacaacttcttcaaatacaaaaaagtccaaatcaataattcttccatttctttcatataaaggaataaatgcatccggtatcataacagttccatccggtctctgccatcttaccaccgcttccgcaccgataatcgaataatcaaaaagggaaactcttggctgtaaatagattttaaactctctgtttcgcattgcaaggtcgaatccattgataatttcattttccactctttgtttttcttccatctcttttccgtaaaccttcacactgattcctgttacctttgagacttgtttccttgcataatttgccgcatcaattgcaatagacgtatttccatttgcttcttcaataaaataaattcctgtccgaatccgaattctggtatccggaaaaattctttcctgctgttctacaaaggtttgatttaaccgatctactgcctctgcggtatcacttctttttttatacggcataaacaacaaaaactggtcggaaactatgcgggtaaaataaatctgttcttcctgctgcatcgttccgataatataattactgaactctctcaacagacggtctcccatctgatatccccatttctggttaaaatacttaaagttctcaaaatctgtgtataccatcacataagaactgatactgtcattagcaagcactcgttctacttcttctttaaaacgggtaaaagaaatcaaaccggtcaaatcatcaaactccggatttgtaaacattccattactcatggaattcattaaaaacaattttccaagatgtgccgcaataatttttgtaatttcacctaaaatctgccgttcttctttcttccaactgcgtttttctttacaaaccatataagaaaccgaacctgcatatttcccctcataatagattgcagtatgcaccgctgttttggcatctccatgaagcagagtttgaattccatgttcactataaccaagtgatttcatctcgtcttcctgaagcactgtcgttccattctcatcataactgtaaaataattttaagaaatcctcttttttataatttattttctgttccaatgcctgcggtacattgtccgctgtccactgatacatcttctcgctcatattaaccttaatatccgtacgaaacacagtaatacgatctaaattaaaacttttacctacaatttctaataaactgtttactgcactgtcaaagtcacctgctttttcaaatgtttcaaatgccgttgccaccagacttcccctgtatccggatatcggtctttttcctcttctgtgctcttctattttttccttcttttcttctacactttgaaagcgctgaagactatcacaaaatacatactggtctcttccgttttcttttgcacggtataacgcccagtctgcattttttaatatctgttcataagtatatcccgaaacattttccggaagataacacactccaatactacaggtcatagagtattctttttcctgaaaagtctgattccgaatcgaatgaactaactgcatagctttacgaaccaatgctttattgggaatatctttgaataaaattacaaattcatcaccgcctgcacgcattacaacatcttttttatcacagaccataagcaacaattttgccaaatcctttaatacaacatctccaaataaatgcccataattgtcattcacatctttaaaataatccacatcaataatcatcagaccacaagcggaataagggtcttttgttcttagatatttttcaattaatttcgttcccgcccttttattataaagctttgtgagtggatctctctgcgcttcttcctgcagttgctcttcccttcttctctctatcgtaacatctctgatacttcccagaagcaccgactcttcattcagactttttggaagataaaccgaatttaaattctttcttgaaatcaaaccttccccctctacatatctgatttcaatcgaatttcgtacttctccattgcaaaatcctaccattttccacttatcttccggatgaattttatcttctttttgcagatattccataaaatgttcaattttttgaagcatctgaaactgaccgtcatataaaataaatacttccctttccgggaaatattcaaataataataattcttttcgttttatcatagaagccaaaattgcctgcctgtgttttaccctcataaccgcttccgtatctttgcattcacctttcatacctcttactccctatattttttatatccatactataccgctctcataccttattttaaaattataccaattttttttaattttgtatactagccaaacggcttgtattctgttttaaactgcgttttttaaccgaatcaagcaagtccctgtcagtaaaaaaaagatgactacacaaaatttaaagtgtagtcatcttctgtctatttcttatttttctataacgtattttagtttgctgcaagctctaacattctctttaatggttttcttgctgattcacgaagttcttcatctaattcaatttccggtgccattttttcaagactttctaatacattttccaaattcacttttttcatatttggacagaactgacgatgtccgactgaatagaattttttctctggatttttctgcattaattcatagaaaattcccatctctgtacagataataaagctggttttttctgaagaagttgcataatcaataatctgtgaggtacttccaataaaatctgctacagaaagtgtatccggtgtacattccggatgtgccagaaccattgcttccggatgtacttcttttgcttttaagatatcttctttatgaatgctcttatgtacatgacagaaaccgtcattaaaaataaaatgtttgtccggcaatttttctgctatatggcgtcccagattttcatccggaataaagaaaatgtgttcatttggaagcttctttacgatcttgagcgcattagaagaagtcacacagacatcagaatgtgctttaatctcagctgttgaattgacataacagacaactgcaacatccgggtactgttctcttacttctttaattttttcaacatctaccatgtgagccattggacaatctgcactggactctgccattactacttttttctcaggatttaaaatctttgcactttctcccatgaatgaaactccacagaataaaattgcatcttcagatactgttgtagccttttctgcaagataataagaatctcccacaaaatctgcaattgcctgtacttccccatccacataatagtgtgccagtattactgcatttttctcctttttcagtctggcaatcttttctttgatttctttgttgctcatattccttccccttttcatttggtttgatttttaaaaagcacaccaaaagcgcactttcttattattactcttcctgactgtcactctttttacttccgcgcaaatcataatcatccagaaaattgtaagcttctttgtctttgtgataaccgataaccgttcttaaatttatattacggacactgttaaaaatattggtttcgatcacatcgctggtctttctaaactgcgcaaccagttctttcatctcatcacgttttgaacctctgcctccgccacagctgacgcagttttctgtaaaacgacatgcacactggataaaatgcagtccgttgtaatctctccatgctttaatcgcatcttcttttaccatgtataatggacgaattaattccattccctcaaaattctggctgtgcagcttcggcatcatggtttctacttttccgctgtataacattcccattaaaatggtttcgattacatcatcaaaatgatgtcccagtgcaattttattacatcccaatgcctttgcatgagaatacagatagcctcttctcatacgtgcacataaataacatggatttttttcgattgttgctacagtgtcaaaaatttcactttcaaatacggtaagtggaattccaagtaaatctgcattatcctgaataatcttccagttatcttcattatagcctggattcattacaagaaaaactgcttcaaaatgaatttttccatgacgttttaattcctgaatcagttttgcaagcagcatggaatcctttccaccggagatacagactgcaaccttatctccctcctgaatcagctgatattcatttaaagcttttgtaaacggacgccagatggatttccgaaatttcttaataatgcttctctcaatttcttttgtcttttcttctttgctttcttttgtatcttcttccagaaaacgacttaaagaaagacgcagataggcacgatatccaccttctacattaaaagcattgtatccggcttttgtcgctgtttcaatataatccttacttctctctccggtatgacagataaagtaaattggtttttctttttccaacacttcttcatatcgtgaatcaaactcttccatcggcagattcactgcccccggaaaacttcctcttttgtattcttcctccggacgcaggtcaatcacctgaatctcatctgcacttaactgttctaattcttctacctgaattgttttcataacttcctaaatcacctgtattaaaatcatatttacggctgttccaagcaaaatactaagaaacgtattatgcttccatttataactgactgcaacaactgccactgccaaaaaatttgcgattcctgtgtgagaaaaatcactccctgtttcctttaaacaatacacaatcagcacagccataattgctaatggcaggatttttccaagataaatcagtttttccggcattttgcgttccccacgaaatgcaagaaacggcaatgcacgcaaaaaaaatgtaatccccgccgacactgccacaaccagaaaaaagaactctatcttcatgactgtgcctccttttctctcatcaaaagcagaacacctgaaacaagaattaaagaaggcagcataaagcttcttgctcctgctataatcagacacagcattgagattataagacctaaaacggccggtacatgattctttgttttctcccaattatcgataaaaataatgacaaacaatgcggtcatgcaaaaatcaattccctctaattttatcggaatcagctgtcctaaaactccgcctgcgactgtacctgccatccaataacatcttgacagaaatgcaatcacaaacatcatgtcctctttttcttttccggtttccatcaggcttaaattaactgcataagtttcatctgtcattgtatgaatcatataaagaagtcgttttcccatcttcttaaattcatctacaaacgttaaactataaaaggtctgcctgctgttcatcaaaaatgcagtcaccgcaatcgtaataatagaagttccaccacttaaaaatgaaaccagcacaaactgaaatgctccggtatacacaaccaggctgataagcagtgactgataccagacaaatcctgcttcttccattgtaattccatatgctatactgacaaacacatagctgcataaaattggaattgactttaaaaatgctttttttacggtttctttctgcataaattttatcctaaagtatcgccaaattttggttttcaatccgttagtggcatagtatcactattgagaaaccttgtcaagtgaactactctgctacaagtaaccgagcttcttgcttcaatcaccactgctatacaaatacaaaaacagtatctgcatagtcttacaatgtcaccttttatttttgaattttatattgactttttgccagattctgctagaataatgccttgtaaaattaagtagtggatttttcctgacggataaaaccgtctcttttcgccacacagcaagaatgctgtgtggctttttttatctccaaaatctgctgtatttataattcaaaacgaaaggaaattaaacacatgaatgacaattttatgaaaaccaaaccggttttacctttgcttttatctttagctctgcccatgatgctgtccatgcttgtaaattccctttacaatattattgacagtttctttgttgcaaaaatcagcgaagatgccatgaccgcactttctttagtctttccaattcaaaattttattaatgccgtagcaattggatttggtatcggaattaatgcagttgtcgcatatttcttaggcgcaggcgataagaaaagtgcaaatcaggcaacaacattaggtataattcttgccattatccatggaattctcctgactgccggaagcattttacttattccatattttttaaaaatgttcagtcattccgaaaacgtaatttcacttggaattgaatatagtaatattgtatttgctttttcactgattattatgttaaatgttggatttgaaaaaattttccagtctgtagggaaaatgaaagtaacaatgtttagtatgatggcaggctctataacgaatattattttagacccgcttcttatcttcggtatcggtccatttccaagaatggagattaaaggagctgctattgcaaccaatatcggacaacttgtctgcatgactatttatcttttgatttttattttccgtccgattcaggtaaaaattcagaaaaaatatgcgacactggattttgatttaatcaaacgtttatatgcagttgggattccggcaactttaaatcttgccctgccatccctgttgatttctgccctaaatgcaattctagcttctttttcaggagtttatgtattaattttgggtgtctattataaattacagacctttttgtatcttccggcaaacggaatcattcaggggatgcgtccggtaattggatttaattacggtgcaaaagaatataagagggtgaaaaaaatttacaaaattgtccttcgtatgagtgctggaattatgcttgccggaacacttatctgttttattattccagatgttttaatcggattatttacaacaaatcccgaaaccattgaggctggaaagactgctctgcgtatcatcagtattggatttttagtatcttctgtctccattacttcttccggtgctttagaaggtctgggaaaaggagtgcagtccttaatcatttcactctctcgatacatagttgtaattatccctgctgcttttcttttatcacgagttcttggtgcagcaggtgtctggcatgctttctgggtatcagaagcaataacggcaatcgtatctttagttatttatcaaaaaacagtaaaactaaattagacttttatttaaaaagagcaaatagccagtacttgtacttattcctgaccatttgctctttcttttctgctttttagatttgaaactttgcacctatttcttctttttctcataacatgatatcatatcctgcctaaaaaaaatgaggtccctcttcatgaattcttattgcagttctatcctttttgaccacggtccgaatccctttacaatcaatcttagaaatgctgcttcccataactgcaattcctgtactaccctctggagcggttcttctcttgaacttaaacttctaaacattctgccatggaaaacgaccggatggaaacagcatcctgaaaccgatcagatcattcgtattgaatgtggcacagctcttctgattctcgcttctaaaaaatgccatcctaattctcaaaaaacgcttcataacggagacgccgtctttattccagctggaacatggtataacctaaaaaatatcagcaagtgtccgttaaaactttctttggtacagatttcatccaataacttcaaaaactaattttatgttttttggatatcatagttctatgttctgtggtaaaatattgtaaatgtcaaaatctaattttttactgaactaggagatgaaagaacatgaaacactacattgattttattgcagaacaattaaagacattaactgcaatcccaagtccatccggctataccaaaaatgcaacggactacctgatgaaactgcttcaggacatgggatatgaaccgaaattatccagaaaaggaaatgtgtttgtaacccttggaggggacggtgaacctctggttttagctgcgcatgttgacacacttggtgctatggttcgctcgattaaagacaatggacgccttcgcccgaccacacttggcggacatgtctggagcactgccgatggtgaaaactgtaccattcatacaagagatggcaaggtctacaccggtgttgtcttaaacactgagccatccgcccatgttgccgataaaaaagtagaaacccttgaagaaaatatggaaattttactagatgaaccggtttctacaaaagctgaaacgcttgcgctcggcatccagaccggagatattatcgccatggaccctcgaacagtcattaccgaaagcggttatatcaaaagccgttttcttgatgataagctttctgcttctattcttcttggaatcgcaaaaattgtaaaagatgaatctctttcctttcatcggaaagtttctttattatttaccgtctacgaagaagtcggacacggcggaagttttgttccagaagatacaaccgaaatgatttctgtcgatatgggatgcgttggggcagaccttggctgtactgaacggatggtttctatctgtgcaaaggattccggtggtccttacaactatgatttagtaacggaactttccaacattgcaaaagaagaacagctcgattatgcgattgatgtctatccgcattacggctctgatgtagaagcaactcttcatgccggttatgatatccgtcatggactgattggtcctggagtttacgcttctcataactatgaacgttctcaccttgatggtgtaaaaaacacatttttattgctaacgacttatattacccgataattttttaaccaaatcaaggaagtcccctgcttcaattgccaaaagcaataagcaagggtcgggacttgcttgtatcaggagggggcaagccccttctgataagctgcgtagcagctatttggttatgagcaagtagcgaaagcggattgcgaatatccgcttgacgtattcaaaaatccgcagccaccggaaagttaaacttcccagtaactgcggattttttcttcgtttagatgttccccgattacaatctgaatttcctgtccctgaggaatcggactgatacaaagttcatcctgcgttgcatttaattcaatccagcttccatcttgattctgactaaatcccttgatacgaaataccttgccacaagatgcatcttctaagatttttttcacctgtgtttttaaagtctcggcatctaatttcacatccataaaataaagagattcaaacccactttcctgtgatacatccctcttttcataagactcctgaacatatccggcttctgcaatctcggaaaaatcatcttctgataattcactgccatctcttctcataagcatctcatctcctaaaattcgattgcactgaatctctttcaaagactgatttaaagtggcaatagttgtattgatttcttctttcgtcgcttcttctgaacggctcaaaataatctttccagcatgagcagcttctgatgccagaagataccttgcttcctctgataaattcttctctgattttgcatttacaaccgtaatcacacttccgatttgataccatttatctaacggttcatcacgaagcacatcaaaaaattcatccacatcataaattccggaaggctctactaaaattcggtcataaccacacattcccattgcaattaattttgtgcgaaaccgtcttctatgtgtctctttatcacagcctccggctatcatttcgagttcacatttttcgccctcaagttcctgtaacagcatcatatctacattgacagcgccataatcattttccaaaatcccgatattaagcccttgacttattaaatattctgcatatttttttatgaaagtggtttttcccgagccaagaaaaccagtaattaaatcaattgtaaccatatttacgatcctcctttctttgttcctgatacatctttttccctcaattttcttcggtttttcgcatatcattctatcatatttttttggagcagaccagatattctgcctgaactttttattgactttttttatcaatcagcgtaacataagctaccgaaaaagaattttttaccaattataaggagaatgatttaagaatttatgacaacaatgaaaacgcaaaatcccctcggttatgaaaaagaatccaaattgcttgtcaattttgcaattccctgcattatctcaatgctggtgacctccctttataatattgtagaccagattttcattggacaagggattggcatgctcggaaatgccgcaactaatatcgcatttccgctttccactacctgtaccgcactctctcttttactcgggatcggaagtgcaactaatttttccctgcatttaggggctggagaaaaagaaaaatctgcccgctatgccggcaacggaatctttctgatggcagtattcggactttgtctgtttcttgcaactacactttttttaactccaatgttaaaatttttcggtgcaaccactgaagtcctgccttatgccaaacagtacacccgcattacagcctttggttttccatttttaattgccaataccggaatgagtaaattaattctggcagatggaagtccacgatattccatgatttctatgttaatcggtgcgattgtaaatacaatccttgacccgattttcattttcggtctgcatcttggaatgaccggtgctgctcttgcaaccattatcggacagattgtttcttttagtatcagtcttcattatatgtttcactttaaaaatattgtgctgaatcgaagctgctttcaaattcagctgtcttactgtaaagaaattttccgacttggcgcaagtgcctgttttaaccagattgccatgactgtcgtacagattgtaatgaacaacacactggcacactacggggcaaaatccatatacggaggtgatattcctcttgcctgtgccggaatcatcacaaaagtaaatatgatttttatgtcctttgttattggaatttcacagggtgttcagccaattatcggatttaactatggggcaaaaaaatataaacgtgtacgaaaaagttatctgcttgcgcttggtgttgcaactgtgctttccggcattgcattcttctgttttcaggttttcccaagacagattatcagtgtattcggtgagggaagtgagttatattttcagttctcagaacgttacttccgaatttatatgtttttaaccttaatcaatggaatccagccggttacttcaaacttttttaactcgattggaaaagctcaactcggtgtctttatgtcactcaccagacagattttattcctgcttccattaattattatcttcccactttttatgggaatcgatggtgtcatgtatgcaggaccgatcgccgatgcagctgcggcacttgtctgcggctattttaccattcgggaattaaaagagttgacacaattggaaaaattaactctgaatctttaagttcatgaacaaaaaagcttgtcctgaataaattcatattcaagacaagctcattttaaactaaattttaattgactttacttcattttcttttcatttcagttttgagattaagataacggaatataccgataataatgacaactgtttcctctcgtttccggtccggcttcttcataccagttatactcaatttcttcgttttcgtctgcccaaagttccggacaatccgtatactcccaatccaccggaatcttatgttcttcctgcaaggatgcttttaacatcatctgatgcagttcttctttttcggtttcatttaatacacccggttttgctgacacaaaaagtgatgtaccggagcgtgttactaaatctgcccactgtgaatttaatttccacggaatattttccataattccaacgcagtctgcatcaatatcaaaaaatgttccatgctgaggcagacaaaatgccagcgtattgactcccatcattttggtacgctcccaggtttttccactggtatcatccccggttctctgcatgtgcatcaaacctgcacccagatgtccaatcgtattgcatcctaaaatcatcacatgatattctttggctgtctcataaattgcacgatataactctactacaatttcagcacttgttttggatttatcataaaagctccagccatccgaggttgggaacggattcatctcaagtccccatctgccaaataaatcaaaggttgtaaaatcatgtttgattaaggtatatccccactcgcagattcgtttgacatcttctttaatataagcaagcgcctccggatgtgacgggtcgagacagccgttgtgagaaattctccattcttccggaatcgtctcttcctcatttaagaggaaacgaacccagatacccggacgtacccctttttcttctaatttttttgcaagtgctcccatgtccgggaatttttcatttccttttttccatggtcctccattgtattcatccagccgatgatgttcctgccagcaatcgtcaatgaccatataaggacggttttctgcgccttttgtaatgtctacaatataatcggtatcctgtaaaatttctttctctgagctgtctccatatgcataataccagttgttgcttccatagaccggaaaatccggaaaaatcggatccgtgcacatgcatttacaaaatgcttttgctgcttcaaaagaggtacaatcatctgcctgcattgcaaccacttcagctgctaacagctttcttcctgaaagtacaacccccgttccaccacagcgtacatccaaaactaaggtaattcctcttgtatcagcctcccagaaacacatggcagaaggacgaacttttacaccatatcctgtcacgactccttcatttaatgcaagaaaataccaaggcataaagcgtgttccgctcattcccttccattctgcatctccataagttctctcccagactccgccaagaatctttgacgtacgctcaagcggagtattccagcgaagctttactgtttttaccggtgagttatctgccgtaagccagatttctccattttcatttgcttcaacacaaatatcttctttttcaaattttgaactgttttgttctccaataaaagaaccttcttcactctctactgtaatataagatggtactcctaattttatttctcttttcttcataactttttcctcatcatatttctccatgaaatgcaccttttcggttttcaaataccaattcttcttttgtctgacgaaacgctttcggacttatatttgtatagagccggaacattttcgaaaatgcaagctgatccggatatccaactgcctctgccaccgcattaatcggcatatctgtattttttaacagattttttgctttttccatccgaaattttaccagatattcctggggcgaacatccaattgtttttttaaacatattcgtcagataactgcgattaatcccgatatattctgccagctcattaatctttattttttctctgtaatgatgttttatatactccattgcatgttctacatatacagtccccggataggtatgctccggcatcgtttttgtattaaatttctcattgtcttctattaatgtcgccagaaacaaattcaaatacccattcctacgcatcgattcctccgttgtaagtcgatgcacttcaagtatctcatccacatacgattttaaaagtgctgtacattttaaacttcgaattgatttctcttttgaaaatcccgcatactgcattactttttttactttataaccatacagcccaatccatgcataggcccatggctctttcttatccgcttcataccaggcttcttcttccggacaaagtaaaaaagcatcgccggttgttagatgaaatacttcaccattcttttccagcttcccttttccatttgtaataatatgaagcacataataagtccttttgtttggtccaaaccgatgtccgggataacatcgctcccatccacaatatccaagacttaattctgccgaatcaatcggcaaatcttccaggcatttatatctcccctcattcgtatatgccgttacctgtgtcatatcacacttcctcttttttataaatgtgatgcggtaaagtcaccttttacagttcccaattgaagttcttcttttgcttttcgatattcttttgggctcactgtaaaattctgtttaaatatctttgaaaatgcaagctgatcctgatatccaaccgcagctgctaccgcattaatcggcatatctgtattctttagcagattttttgctttttccattcttaaattcaccaaatattcctgtggagaacagcccactgcctttttaaaactgctcgtcagataactacggtttaccccaatgtaatctgccagctcattaattttcaccttttcctgataatgatgtgaaatatattccatcgcatgacgtacataaaccactccgggataagagtgctgctgtgctgctggttccgtcttcttataatcttcaatcaaggcagcaaaaaacaacatcagatatccatttcgtttcagctcatcggtgtaggaaagctgatgtgccgccaaaatcccatccagatactgattcaactgttctttacattctacatgcctgataggatttctcctcgaaaatcccgcatgttctgcattttcttctgcacggtagccggtaaatccaacccacatataacaccaggggtctttcttatctgcttcataccaagcttccacttccggggcaatgaaaaatgcatcgccctctttcaactcatatttatgtttattaatttcaagtattccttttccgcttctcacaatatgcagtacataagacgtccgaagattcggaccatacttgtgtcccggattgcagtattcccaaccacagtaaatcagacacaaatctgctgaatctttttgcaaatcttccagacaacgaaatctggcagaattggtatatccggctacgtgtttcattctttactcatccactttctttaaggtatacagaagtgatgcaaaatctccgccttttttattcaattcttctctgtcaattggaattccggcgctcatcaactcatcaccataagcctgataggtttttacactgtcttcctctgttttatgaccataagcttctgcaatttttgcatcataagaagtaaccggtgccatatcgcagctcacttcatattttgtattggcatcaagtccatccagttttaaacgaagccaggacgcattgactttatttaatctctgatagaatgcagccaccgcctgtgttttatcgctggaaactaccatccatgcagtttcatttccttcaaacggactcaacagacgatagaaatcaccatccatttgaattaactctctgtgttctttcataaatgcaatctgtttctttactgtctcaatttcggcatcgctaagtaagtttaaatccagctcataaccaaatgttccaaaataggcaacatttgctcttgtctcaatcggagtaattcgatgcatctgatgattcggaactgctgaaacatgggaacccatactgacaatcggatagacataagaggttccatactgaatctttgttctttcacttgcatcggtatcgtcagagcaccaggtctgcggagcaaagtataacattgcaggatcaaatcttgcaccaccacttgcacaggactcaaataaaatatgcggaaattctgtcgtcagtctggtatataaatcataaactccaaggatgtatttatgcatcacttttccctgctcacaaggcgcacttcctttgctgtaaggttcagacatatagcggttcatatcccatttaatataagaaattgaagattcgcggattacttttgcaatcatctcataaatataatctaccacttcgtttcttgagaagtccagtacattttgatgtctcgcatgagactcaaaacgatttggtgcactgataatccagtccggatgtgcacgatataaatcactatccttgttaaccatttcaagctctacccaaagaccaaattttaaccccagttcttctacttttttagagagccccgaaataccatccggcaatttttccaagtttacataccagtcaccaagacctctgtaatcatcatttcttgcaccaaaccatccatcatcaagtacaaataattctacacctgcttcttttgctttttttgcaattgttaaaatcttttcttcattaaaatcaaaataggttgcttcccagttatttaataaaattgggcgtgccttatctctccattctccatgcatcagacgttttctgtataaacggtgataggtctgactcattttatttaagcccttatcactgtaaaccataacaacctccggagtctggaagctctctccactctttaattcccagctgaaatcttccggattgattcccatcatcacacgagtcatatcaaaggtagaaacttcaacctgtcctaaatagttaccgctgtaaaccaggctgaatccatagacttctccctgactttctgtcgtatgtggacgttttaatgccaaaaatggattatgctctgcgccacagcaggttccatttaaactctgaatactctggattcccatttccagctttctgttttttacgtaacgctcacgtgaccatccaccggaaagctgaaccatttcataatccatatccaaaaattccacactggcactcatggcacgttctaatacaattttttctttccctttatgtacaaacttcgtatttcttgtaataaccggatacgcctcataaatggtataagacaaaatcaaatcagtatccatcacgttatcatgcagagtgacttcaagagtctctgcttcctctttttcctctacataagttgccggaagtggaaggatttcttttttccctgaatagatttcatgacctgcatatttaaaatcaataatacggcttccattttcctgtgcaatggtcactgccggacttctatagtcaccggttccataacttggatattcctgtctggtatactgcatggataacagacccggctccggaatacaaacagacatctgagaacgcattgcttcatcatggaaataagcaaagtcttctttgtcatggattttctttccataatataaattttcaagctgtccattttccataatacgcataatataacttacttcattgttgtaaagatgaaaacatttgctttgtttgtgaaaaataattgccatatcttttttctcctttttctaaaaagaccgacgtagaactctacgtcggtcttaaattcataattaaagttttccaccacttgttgcaataccttcgataaactgtttctggaaaattacataaagaacaatcatcggaatacatgcaatcagagaagcagccatcagttccgggaacttcgcagcatactgtccctgcatctttgcaagtgcggaagaaagtaccaacatgtctttatccgtatttacaatcatcggccacatcaaatctttaaatgcaaacactgcggtaaagatgcccagtgctaccatactggatctggtaagtggtgccataatgtataagaatgtctgtccgatattacatccatccagacgtgcagcctcttcaagatcatttggaagtcccatatacccctgacggagcaggaaggtaccaaatgcggtaaccatacccggaaataccagaccaaaaattgtatttaacattcccatcttacttaccataatatactgaggtgagatgaaaatctgtgccggaaccatcatctgcagcagtactaaagagaaacagaaatctcttcctttaaaatgcagacgaccaaacgcatatcctgccattgtcgcagttaacactgcacaaagtacacggaagaaaatcattaacagtgtatttttgtataatacaaagaagttcatgttacgaatgacttctttaaatgaatccgttctccatacctttgggaaaataacaaacggatcgacacttgttgcctcagtaactgttttaaacgcggttaaaatcatccatataaaaggtaccagcatcgtaatggatacaagaatcaagattacatggattaaaactttcgtaaagttctcttttgctttcatgttgccttccatactgcttcccccttcctagttgtagaatacccattttttctgtgcagtcatctggattgcagtgataatcaaagtaatcaccaaaagcagaataacaattgtagaaccataacctatgttcttatttgtaaaggtatatttatagaataagaatactaaggactgtgttttattaagtgccggatttgttttatccataaccatgtagatcaaatcgaatacctgtaaagcaccaataatacgtgtaatcataacaaaaaagatggttggggataacaacggcaccgtgatattgaagaaacatttgattcctgttgcaccgtcaatctcagccgcttcataataatcatgcggaatttcctgcagtccagaaataaacaataccatgttataaccaatgatagaccagataccgattactgcaattgaaaaaactgcaatccttgggtctgaaatccattttgtatgtaaatgaaacagattgttgatcagaccaaaatctgagttaaacagccatctccaaaccatggcaactgctgccggagctgcaaccatcggtagaaagataatggtacgataaacagaacgtccgatcatctttcgatttaagaacacagccagtaccagcgcgataataattgaaaatggcacttctacgattgcatacttaaatgtattaagcaatgcctgccaaatttctttatcggcgaatactttctgataattttcaagtccaacaaagatatttcctcttccgaaatctccggttttaaagaaactctgataaatcgtctggaaaatcgggataatatttaatacaatcaaaccgattactgtagggagaataaaaagccagccccagataaattcacttcgttgtcttccggttgtttttactttcgtcttacctgccaaaccactcactccttttttaatacaggcagattctttcgaacctgcctgtgtctcttgctttcattctacttcgttacactataaattgcgttacaaattactgctgttcttcagccagtgattcgttcatctgctctgccatttctttgcaggcatctgccatagttttgtcaccgctgtaaacactcttaagaatttcactattcttgttttcccatgttactgtagaacgggagtatggtctgatctccatatcatccatcatattgatgtaagcctgaagattaaagtttgcggattttgcccatgcttcagatgttccggtataagcagacattgtaacacccagttcagcctgtttttcctgtgcttctttcgaaccaaggtattcgattaactgccatgcttcttccggatgctcggtatttgcggatgctgcccatccaagaccattgtaaagagaagctcttctgcctgttgttgcgctctttggaagttctacacaatcacagttctctgcggtgtattcgttatcacggaatgttgcgatcatccaggagccctgtggaaccattgccactttaccggattctaataatacatcttcaccgttttcagacattgtctcgattggaggaagcacaccgtctttgatccatccttctaacatttccattgcttctaccgtttttggatcatccattccggattttgttttgtcatcattgataatatatccgccattatcatagatcaggttgtagtaaccagcctgattgttatcatttctaagacataaaccatactggcttccatcgtcttttgtcagcttcttcgctgcttctgtcacgtcatcccatgtccagtcagcggtcggatactctaatccggcttcgtcaaacatttttttgttataccataaagcaatcgtatcgatatcttttggaactgcgtaatatttgtcatcgtatgtatacagtccccagatatcttccggatagtttgcagggtcaatttcactgctctctgcaattttatcagtcaaatctaataacatgtcatttgacatataacgctgactttcgttagaatgcatccagaatacgtccggtaaagaaccacctgatgcaccagattccagaagtgtccagtattcatcccattttacaacagaaactttggttttgattccagttttttctgtgaaatcattcataatttctgtcaatccaggttcctggttggaatcccagattgttacggataattctacgtcccctgaatcactctctgattttttgtctgagctgtcgcctgaacttgagtccccgcttccgcatcctgccatggtaaataccattgcgcctgtcagtaataatgccattgcctttctgaatttcataattttttcctcctttaatgaaaaagaatattctctataagtagggttgcttcgtccctcactcatttgatgaattcattatatcgagatatgtcaaaatgtaaaatggaaatatgtttttaatatatggagaaatgttgtttatttgtgcattttctatatttttttgtcttattttctttttcaacagtcatttttatatttatatgtctggtttttcacaattttattcggtgtttttccaacaaagctctctttatatttccgattttgctttcatttttccacatatacataacatttttccatatccttttctttttatttgtttttaaactatatttatattcaaaatacccgatatctggaatttttcttttttattttttgcattttgacatattcaatgttaaaataaggtatcgtgcaattttacatcacttgattttttgacgaaaggatatgattttatgaattttatgaaccaggacaacattgtcgtaattgccttaaaccggattggagatgttatcattgcaaatctgctttttcttctctgctccatcccccttgtcaccatcggtccatcccttactgcactatatcactgcatgttacgtatcgtaaaaggaaatgaagacaaggttactaaaactttctttcgggcattacgtcagaattttgtgcagtctttgatcgcctggcttgcacttgttatcgttggtgtgattttgtttttgaacactcactttctcctgcagaatacttcagaagccggaaaaatcttttattatctgtccgggctggtacttgtactgcttgttattatcgcactttacatctttccggtcattgcggcattttccaataccttaaagaaccttgctaaaaattctgttatttttgcatttatgcatattccgtccaccttgttaattgcagttatttctatcctgccaatgtatatgacttatcaagatttaacacttttaccactctacagctgctgctggtttttcttcggctttgcattaacctgctatattaattctttcttgttttatcggatttttaaaccgtatctggaaacaagcgaagaaaccgaagaaataaaagaaatctccaaataaaaaaatttccgaatagtaaaataccgacaaatgaatttttattctcatctgtcggtattttactattcttcctcaaattcatctcccacatctttcccaaggtcgcaggtataacgccattcaattacatccccgtcactgacctcatatttggaacatccataattgggaaaatatccattcacgctgtaagtccatccagaacgttctccacagtcaaattcatacaactgattaattccttttacataatacgcagaataaagcggagtatagtttgcatccagctgaatttttttctctttacagacacgcgcaagtatatcatagacggtatcacccgtttcatatttcacctctatcggttctaaaatccagccatctgacggaacaaattcctttttcgatgcttttaactctttctcattatccaaaatagtagaacattcaatggaaaccgtacatttattcttttctacattctgtttatttgtctgctgtttctcttgttgtgtttcttttgtttccagttttgtaatctcactgctgtttgtcattccaccacagcttgtcaaaagaaaaagaagtgtcagacaccctaagatttttctaaatttttttctcatcctttaatcctcttctatcattccatacttcactttgattctctccagtttttcaatcatcggcttacttgcaatccacaaaaagattaccgttgctgatgcatgaaccaagtccaccggaagccctgacatataaattgccagcagatttcgcttggtaattgcataggaggtcatcacaagggaagccgggttcatgattcctccatagataaacacggtcgctaaaaatccataaatacaaagcgaaatcttacgtgctttcaaccagcctttttgaaataaaatacctgccaaaaatccgataattccagcagcaaacatctgccacggagtccacggtccctgtccaaagagcatattcgaagaaagcatggaaagcgcaccaactaaaaagcccgattctgcaccaaagcagacggctgaaataatggtcacagccacaaccggtttaaagcttggcaccataaaaaatgctgcacggcctgcaactgcaattgcaaccaaaaccgcaattgtaagcagttctcttgcctgcggttttcttccttcaaaaatcaaaaagaacggcagcatgcagtaaactgcaatcgccagactgatgacaaaatattttcggtcatcaaaaagcgtaattccaatccagattgtaaccggaattaaaattaaaatcaaaaacatagatgcaatcgtacgttttgacagctttcccttgtgttttggcgctgtcagtacatcctgcgcttcccagaaatcgtttttttccggttctgatttctcatcccagaaatccaggtctgtttcctgtgccggtttcttcccatctaaaaaggcatccagaaagacatctaatttttcttctttcagcacgacaccgcctcctcttctgtctgattgattgcttttaccacatcctctactgttaccgcatttggaaaataatttcttgccatacggtttgcagcagtggtataaaagttatttccggcaaaaaattttttcgattcttcactggttaccacatttccctgaaagaacagtccggtacgatccgcatactgcgcacaaaattctacatcatgagaaatcatcaaaatcgttacaccatgttcacttaattttcttaatatctctccgagttcttttttataatgattatcgattcctttggtcggctcatccatcaaaagaattttcgggcgaagcagaagtacttttgcaagtgccagtctctgctgctctccaccacttaaatcatagggatgccggtctaaaagcccttctaatcttgttaacgagacaattccctcaactgcatcttttttcttcatttcaattggatatgcctcactttttctttcccgttttccatctatcacttcatataaatcctctcttacggttttcttcacgaacagactttgcggattttgcggcattactcctaagaacccatgatagaggtcatcatcactgtattttccgatttctttgccttccagatagattttaccacggtacggaaaacgaattcttgcaatcagactcatcgctgtactttttccggttccgtttcctcctaccactgcaaagatttctccttttttgatgtccaggcttaacccttttaccacatccggcaaatcccgttcatagcgaaaccagacatctttgattcggatttccggaatttctttttccggttcttttttcagacctgaaagttttccaaaaatagaattcttcttttttgctgtctcttcctgatttctttctttttttatttttataccttttgtctctaattcctctgacagccagcgtcgtccctgactaacggtaagcgggcatcgaagggaactgtttattccggcataaatctgcatcggtgccggcatggaaagaaacatatcatgtcccattgttcttaactgctccccaatttcattcggtgttccgtctgctatcatccttcctttatccatgacatatactttatctgcccatggaatgacatcttctaagcggtgttcggttaaaatcacagtagtcccgatatcacgattaattttccgaaccgtctctaaaaaatcggaagctgcaattgggtcaagttgggaagtcggttcatctaaaatcaaaagtttcgggtgcattgccataacagaagcaagatttaagagctgtttttgtcctcccgataattcactgacattttttaaaaaccaggaatggattccaaaataagaagccatctctgccacccgaagccgaatcgtaggcgtatcatagccaaggctttctaatccaaaagcaagttcatgccagactttatcggttacaatctgattatccggattttgaagcacatagccaatttctgcactttgtgtccgcaaatccacgtcttccagattctgcccgccgtataagatttctcccttcttttctccatgtgaagcaagcacacttttaaactgccgaagcagagtgctttttccgcatccactctttccacacagtacaacaaacgaaccttcttctacttccatggatacctgataaagtgccgcatggctttcttttggatattgaaaactaaagttttttacttcgatacaattcaattttttataacctgctttcttttatttttgacgctcacatcatttttttcgggtctgtcaaataccatggaagcctgcgctccatatctgccatttttttaagtttctcaaatcttctatcctcaagcacacctaaaatcacaggaaagaaacaaaatcccgcccatgccacataaataatgacgctaaggggggtcagcggaagtcctccgattttaatctgtgggtcgtactgtgcaaagctaatgcctgctgccattccaccaaaatacactcccatcagtgccagtaaagtgcctgttacaatcccatccctattatcaaatcgaaagattgcaaaagcgcttctcccttttaagccatatcctcttgcacgcatcgaatctgaggtatcaatcgcattttccagtgcccaggtaaccaatacagaaaaaatcgtaataccgtgacgcattttcttaaaaatgtttccgttctttacatctctcccaattgctttttgtccatttcggatgacggtcagctgctgtccaaatctcggcacaaaccgaaataccatagataataccaaagaaagtgccggaatcacacgaccaaacagatacacaaatttatctgttgtcatcactttgttgtaacaggaaaaccatagaatcgaaataaaaagcatcgatgccagtaccagtccatatacaattgcctctagcgtaaccggcccggtttttaaataaaatagcatcgtcactccataatgattaaaagcaggattaataaatgccacaattatcattgccggaagtgttgcaagcagattaaattttaatactctctgccagccttgaagtctggatgcataacaaaatgctcccaggaacgaaattcccagaaaaaccggatggctgttcaacattgttatcaaaatgactgctgcaaaccagaaaaagttcaccgccggatgacaatctgaaaaagcatcccctcttttttctttcatcttttgccctcttttcatttttattttcaaaaaactgctttcaaaatcaatgaaaataaaaatttatcgtacaaaaaatttgtttccgtctatgcctgcggaaacaaattttgtgttttaatctccaaatgcctgtatcctggctcgcagttctaacctacttgctgcccttctcagaagaaatttcttccaatggattcgcagttttcgtcctgattacagtagggataaagtctgttgcggaatctcaccgcacgttccgaaaatcatccgattttcatgcatttgtactatcgattcatttattttatttcattgttttgttgaattttgtcatatttctttcatagtacgctttatcatagagtttgtcaagcggtctttctttccccaaatttccggttatcgctttgattatcctaccagcgttccatcctcgtattttccatctttaaacgcgaagaaaaattcaaagaaatcatcggtttcataaatttccattagttcattcaaattccaaattggatttaaagatgaaagtttttcccgttctacccagaacaccttcccctcttccgaacttttcaattctcctgtaaattcatccgtcttatataaaagtacaagataccttgtcccatcctcccgaatccagtcttttatcccgcaaagctttggatttgaaatgataagaccggtttcttctctcatctcacgaataacggaatccttaagagattctcccggctctacatgcccacccggaaagataattcccttctcattttctccgagtattttttcctctaccagaacacgtcccttctcatcatagagcatacacatgttggctaattccattggttggcttctatccattgcattttcctccatttttgcagatttctatcaaaaaatataccatatcaagtatctcttttctacatcatttttacttttttgtatatctctttctccatctgcatatactatcagaaaccttagatactgcgaggattttattatgactttaaaaacaaatatttatcggtttctttttatttccattctcggcactctgcttcattttacttacgaatggtcacaaaacaatgccattgtcgggcttttttctgccgtaaatgaatctacctgggaacatttaaaattattattctttcccatgttttttctgactctttttgagctttttttctttcgagataggcttcccaaaaactttttacaggtccgaacctgtggaatctttcttggcatggggctaattgtagttgtcttttatactctgcttggtgtgattggaacatccattgattttctaaatatcgcactgttttttgttgctgttttcttcgctttatggagcgaaaataagcagtatagaaattcggaatcaaagaaagaaacttcttctaccgcattttctatcctgcttatctttaccctgctatttttcgtgtttacctttttaccacctgatattggactgttttgggagattacaaaagtttgctaacttctatttctttctactttctttctactttctttcgatacttcccaatcctcttcatcatctcgtcaaaatctatcggtttcgacaagtgctcattcattccgcttttcttacttgccgcaatatcatccgaaaaagcatttgccgataccgcaaagattggaatctctctggcatcttttcgctccattttccggattgcttctgccgcttcatatccattcattcttggcatcatgatatccatcaaaatcaaatcgaattccccaatttctgattttgcaaataactcaactgcctctgttccgtcttttgccggagtgaccaaaactccttgttcttccagcatataagtctctatttcaagatttaattcattatcttcggtcaccaaaatatgcattcccgaaatagaaatctcttcttccctcttctgaacttcttctttttcagcttcataggttttgtcaatttttaaggtaagctccacagtaaacaccgtaccttttccctcttcactgacaaaatctacttttcctccaagcagatccacggtcttctttacgatagaaagcccaaccccgcttccattataagtggttctcgcagtcttatgttcctgtgcaaaaatttcaaatgcatgtttttgaaattctttactcattccaattccggtatcccgacagataaataaaattcttgcacattctccatcggattccatctcccgacaggaaacctgcacaagccctcccgggtgattatattttactgcattgctcatcaggttctgaaacactctttggatgtttagagggcttccaagcagatagcaatgttcattttcaaccggctcataccgaaattcaactcctgcatttttcgcctgcacgaatacaattgttaccgcattgtctaaaatttccttcaaattaaatgactcatttttactttccatttccccggcttccattttactcatatccaatatgttatttaccaattctaaaaggaaatccgaggcggtataaatcttttcaaaacagtctttcatgcgagaaggctcttttacacattccagtccaatctctgccattccgcggattccgttaatcggtgtccgaatatcatgactcattcgacgaaggaaatctgtcttcgaggcatctgcggttgccgctttttctgcactgatacgaagctgttcctgataatccatctcctttttcttttgttcactgacatttcttataagaagcaacaccgatgtctgtccattttcatcatcacgttttttagaaactaatagcatctggtaccattttccggtaattgcttcaatcgtacaacctaaaaagttgcgctctttcattctttctgaaagtgttgttaagtctgtaaattccaaaaaagtctctcttgccgattcaagcatcagtttccgcgcaaattctgtaagcatcttatcggcttctttaattccggtaattatttcttttaattgcgaagtttcaacaaccggctcccaggtattttcttttggatacaggattaaattcacatcataaatacttgaaattgcctgaaccaaataaaattctttctccatccgattcattttttctctcttctgagactggacaaacaataatacaaccagagcaaaaatcagatacacacctgctgcaatgccaagcgtcagtaacatcctcggataaattttctgagcacggaaaaacacatacagataatagtttcggtacatatcatgttttccaaaccaagtttttccctcactttttaattcaatcagattttcatcctctggagtttggtcgttctttaaaacacttgaaatcggacactcagaaatcgaaagtccttccagttttcccgcactgctgctgattacattttctccatctgtcacaacaagcacttcatttttattctgcacaagattatctaacagattactaagtgagatttcgtacttatcatcttgaaacttcgttgtatcgtaataacagataatgattccagactcatcaactcttgaggcaatagcatattcataactctttccatctacttccacactgtcagcaaaaactttttccggaaactgtaagacttcttttacctgagaatcctctaaaataagttttaaaaatgtctcattttctgctttatctaattttacattttctgccacctgcaaattttcatctaataaaatcactccggaaagatactggttttcggcctgctctaacagttctgctttttcttcctcttttatataatatttcagcacattgattttattaatcatatcctgtaaatctttagttgtaattcccatctcataatccagatatttttgacaggttgtttttgcaagatttaaggtgcttgatacttctctttcaattgcctttttctgatgcctgaatgaaagcccaagcgttaaaacaaatagaacaattcctcctaaaattagcccaagcagaatatacttttcactcggactgctccttcgctgtttctgtttggtcatcctccgctcctccatatacatttttttctacatctaacccatatttttctacaattttctccattgtcccgtccttgcgcatttccccaaatgcctcattaagtcttcggacggcatccgcatctccctcttttcgaaatgccactcccacagcttcacttcttagactcatatttaagaaacggtactctcccggatattcctccgtatacgtctgtaaagcgccctcatgtccaatgatggcatctacatatccttttcttaacgacgtaaatacttcaccaagttctcgaaaacaggtcaactgctctaatttaggaaaatttggattcatctgttttaagataatcttttctgaggtagaacctgcctgtactcccacacgcttctcttctaaatcagcaagcgattgtatcgtactatccgaacgaactccaaccacacgctgtgtataaagataaggatttgtccataaatatcggttttctcttccctctattgtcagataagaccacagacaatccaccttcttattttccagttctacaaaacgatcttcaatcggtatcatctgaaaaacaggtgtatatcccgctcttttacacgcctcctttgccacatccacatcgattcccgaataatttccattaatatcctgataaaaataaggagtatacgaagttcctccaattatcagtcctggaaaaactgcctcttttttttgttttgttccacacgcacagacacctaaaatcaccgcaagtgccactacaagtaataccccttttttcctcatagctgttcccctttttacttactccagaatttcttatgtcactattaattttttatattttcctcacagatacgtgtcagcttttctttaaaaaatgaaatcatcctctcccatacttcatcctgaaagaactgtaaatccgcatggtctgctccttccagagctaaaaatgtcacatcacaaccatttttttctaagctttcataaagactttcactttgtgaaaacggcacagtacgatcatttgttccatgaataattaaaaacggtggtgcttcttttgtcacttttgaaaccggtgaattttcatatcctttttctggatttttcatgacattaaagcccagcaacagggattccggtgatgctgcacactgttctgcctcttggtattgaaacttcgaggtatcagttggaggataccatgggcaggcagcctgaaccttgcttgactgttccagataatctccaacatccagtgaaacatcttcatcaagtgccgccatacaagttaagtaaccacctgcggattctccagtcaccccaatatattctgcatcaattcgataccggtctgcatgcgctctcaaatagcgaattgccgcttttacatcctgaatctgcattggatactctccctcattggaggttcgatactctacacttgccactacaaatccgctctgtgcaagcttgctaagataggataaatgcgctgacttatccatgcgaagccatgccccgccacaaatccagactacacaaggatatgtttttccactaaaatcctccggataaatcaaatccagttttaaatctctgcggcagtgcccataccaggaatccacctgtgcatacgtgattcccgtaattgtcacatactgcggtttttccaccttaatttttaatacttctttcattcgttttcctccgatcacctttttcctttattttatcataccctttgtcaaaaaaaaagaatcctgggaggacaggattcttttttcgggtattctatgctttatcgttttcttatttttatttctgtctgtttagaaaattctcttttccgaaacaaacttctgagcagtaccatccacccccacgaaatagaaagtgccggaagtgcggagattatgattcctctgaccggagagatttctgaaaacacagttggtccaaaaaacctgataaacacaactgtcatcatgacaatcaatgtaattttctctttcatggtattcgggggtgtcaggaaaatttttttaaatccatctcaagtctttctggttcttttttcattttaaacaaggcgtacctttaaaatcggcagaaacgaaattttcgcttctgccggtttttgtttaatcttctttaatttttccgtcaattgtaatcgtcacaacctgccatggaatgaatttttcactgttttttaaggctgccaccgctgcccgttccaggcctccgcagcaaggaacttccatacgaagcaccgtcacacttttaatgttattttcagcaataatccgggtcagtttctcactatactctacggaatccagttttggacagccaatcaatgtaatttttcctttcataaattcctgatgaaaattcgcataagcataagccgtacaatctgccgcaattaaaagttttgctccatcaaaataaggcgcattgaccggcactaacttaatctggcatggccactgaccaagctgggactgctggacttctttgacagtttcttctttttttatactttcttctctgttgaattgatgcagggcatgtcctgggcatccggaaactgccggtttttctgatttttcttccttgtctttactttcctgcgcttttcttttcatattttcttttactgctgtttcgtcataagcggctgcttctctttctacaaatgtaattgctccggttggacaatttggcagacagtctccaaacccatcgcagtaatcatctctggtcagcttcgcctttccgtcaatcatctcaattgccccctcatgacaggctgatgcacatgccccacatccattacatttttcttcatttatctcaataattttacgaaccatagaaaaatacctccgtttgttttagctctgtcttgtttacaaacacatagtaaaacaaatggaggcaaaattatgttgttggtacaacaaatttaaaaatcttatttttaattctgcagcatttggatttccgtttcaaaaaaacgttcctgaaattccaccagtgctgcaatctgctctttgctgtatttgcctttttccttacagacaaccagcttgtcttccacgtcattttttcgtttaatcactgccacgacatatccctcataagcttccacagcttcaaattctccgacaacataagcatcgatttcctctccatctccagatacggtatctggaatgaaaccatagtttaagcaatatacaaatccgtgctctggatgtcttgaagcaaggggacggtcgattttcacctttataaactttccaaggtaagattccagtgaaagtgttgtgtttatatctctgttcttcatttacatttcttctttctattcttcagctcacatcggagttcccacttcaattagatttccatccaaatcatagaatcgaacaatctttttcccgaaatcattctccatcagcttgttgacatattctacttccggatacaactgctctagtttttctacaaacttttctatatcacgttcctcgaaatacaactcactggcatgatttttttgtttcacttcttttttcaaaaaatcctgccagatttttttctgctgtaatacaagtccttctgttaagattacggtctcgttgttatccagaacaacttccagaccaaaaaggtcgtgataaaagtgtttggatttatcaatatctgttacaataattaatacgttttttaatctcatggactctcctttccgcagccatagccaacataaagaactacttcgttttcatctttcaacaaagtttctgcaacctgaaacagcaacacaattaatattaatgcttctttcacgttaatcttattataacagatattgtcatttccgtgtaaaaaacagtctttggcaaacattcttttgagatttttatatgaatatgatagactactaactgtaatatatattggatttcttactaagaaatacttacaaaagaaaggcttttttattatttatgaaagaaaagatatttaacatcattcagattggagataaaagcaataaaatcagtcgtgcatttgatatttttattacgattatcattgtcggtaatattattgtcacttttttggaaacgtttgaccagttatcctctttttccggtttatttaaaatagtggagattgtcactgtttttgttttctgtgttgaatacatcctgcgcatctggactgcaaactatctttacccagaagtaactgccggacatgcacgttttaaattcttgatttcttttgatggaattgttgatttgctgaccatcattccggcttttttcttatccggttttgtcattttccgtatgctccgcgttgccagaatttttcatctgtttcgtctcaatgcaaagtatgattcatttaatgtcatcacaacggttctttatgaaaaacgaaaccagattatttcttcggtttttattgttttgattttaatgctcgcaagcagtctgtgtatgtacagtgtggaacatgaagcacaacctgccgtctttcgcaatgcctttagcggaatctggtggagcatgtcaactctgctcaccgtcggatacggtgatatttatccgattacaacccttggacgtatcatggcaatctgtatcgcctatcttggtgtcggagcagtcgctattccaaccggtatcatcagcgccggtttcgtagagcagtaccagagaaaaagcagtatttctgatttaaaagatgcggacattcaggaaattgcagaagtgtttgttgataaacgctatgccggaaaaactgtagaagaaatggaagaggcacagcaaatcaccatctttcttgttttacgtgatgatttttctgtgcttcctcaaaaaaatacggttttaaaattaaatgatattattattattcgggtggaaggggagtagtcagggatgaaactttcgtccctgattatttatccttgtttataagctcacaatcttacactcaaacggtgcaagcgtgatttctccctgtttcacttcatgcgcattatggttaatatacataaccactttctgtgtctcatttcctctggttacgatttccactccttcttcagaaggtgtcatcttgatttcacattctttcataatgtgttccatcaaaagattggtaatcttttcttccagaccgcatcctacatagtaagtcgttccattttcggtcttctttctggtaattgccgcaaattcttcatagaactggtcgccataatggaataacacttctgcatctttggtctgaatcatatctctgaaaattccgccttttccggaaattccttcaaattcaccagttccgattaccggaaatgcctcataatcctgaagactttcagtttcttctatagtaagaccggttaagtctccataatgaaccggcatcgtttcaccaaatggaatattattgtccacatcttttactgcatgacggtaagtaactaccactgttccgccattttttacaaattcatggatacgtttttccatctccggttttgtaataatcatctgtggcaaaatcactactttatagtcagaaaaatctctgtcttccggaatcacatccacaccgacattctgatcatggaatgatttatagaatttctgcatttctaccgaactgtctaacaaaatgctctgtctctggattctgaaagatgccagtgaatcatagtcatatacaattgcaacctgattgttaatcggggcttccattgcttctttataattggaaatatcccggaagaaactctgtacttcatagaattttctacgctttacattatctgcatcaatgactccataacagaactgttctgcaccttttgttgcacctcgatatctaaaatacattaaggaatctgcaccatgcgccatactctgataggaccacatttttgcctgattcggtctcggaagaaaacctgtgacatcatgaccctgagctcccataatggcttctgtaatccagaaattttccccttttaagcctctgatataatccagtccaaatgcaatttcatgaggttgaattggctctttctgacctccccacaccggataattattataggctacctggttcagactttttgctacttttgaataatccacatgttttcctaatcctccacctggaaaatcatgcatgacaactgcatccggtatgatttctcttacaagatttgcctgaaactccatgaaatccacaatcgactgactgcggaatctctcccagtcctgtctcaaagccggattatgcgttgtaatcgtctccatagggattggaatttctgagaaatcattgtattcctgtgaccagaaagtagttccataagtttcatttaaccggtcgatatttcctgcaaatttttcagaaagataactttggaattttttctgacagtttttacaataacatacatcactgccttcatgaccaatctcattatcaatctgccacgctacaatactcgtttcctctttataatgttctactagtttccgaacgattttctcagaatattcatacatccgtggactattgaaacaatacacatgtcttccaccaaaagttctcttttttccaccctcaaattcagaaacaatatccggatattttgctgcgagccatgctggaattgtagccgtcggtgttcccataataatttttaaatttcgttcttttgctttttctattacatggtcaaaaaaagaaaaatcatactgcccttctcttttctccatcaaatgccaggaaaattcagcaattcgaatcacattacagcccagctctacaattgtatccaaatcctgttccagcatatcagcatgccattgttccggataataatctactcctagccacataatttttcctccctaattttcatataatatcggattctttcctgcacttgcttttgtaagtgcgaaagtgcattttctaactatatggtagcaaataaatttttacctgtcaatgaatttttactaaatttatttatttttatagtaaattttttacttgccattattttcctgctttttgatgcttccacgaataaccagactacatggaatgacaattttccttggaagtttctctgcattccagaatctctcaagtgcaaatgtcgcttcttttgcactttcttttaaataaacctctatggaatcaagtggcggtgtactgctctcagaaaaggttgtattattataagttacgatattacaatccccaggaaccaggaagccatgttcacgaatagctttcaaaatacctgctgctgtagcatcactggaaataaaaagtgccttgggaggttttttatttttttctaaatagcgttccatcgcctcataagaacttccggaattcatctcacagtcaatcaccagattttcatcaaacagatttctgttaatcatcgaatttttataataataaaatcttggatccatcgtaagcattttcaccctgttatacgtataaactgcacctgcataggcaactctctcatatcccatctcatcaaaatgattgagcaccagacgtattgccatatgatagtttggaacaatactgtaatacttcatctcatccggcgaggaatcaataaatacaatattggatgtatacttttcaaaactgtgaatttcttctgttgtaaaacgtcctattgccactattccctctaaatttccatcactgtttttcacaaaattcccatcactgtttcgatataaacttactgtattccagccattagaaaagcactctgcttctaccatattttttaacatcatgtaataaatatcatcctgaagctgttgcatttcaaacatctgtgcaattcctaccgtaatgtttttgctgtttttaatcttttcctgatttcgaaccctagtatccttgtgcctttgagatactgagcgatatcccaactccactgcaattttcgtcactttctctcttgtttctgccgctacattcaaagtactgtcgccatttaaaattcttgataccgtcccctgagatacgccggcttttaatgcaatatcttttaatgttgccataagttccccttccacaatatttaaatttttactaaaaatctattaaaaacagtttatcacaagaactgctgtaatgcaaaaaaaccgactgaataagccggttcttttgcgtttttattctaactatttttctttctttttatccgtatttacttttttcaaaatttcttccagataagcgccatccagcttatatccttttgcatagattacaaatgcaagcactgtaatgatggtcggaatcactcccataagaactctcattcccatgatagtcgatgcagactgttctgcatttgcaacatatcctacaattgtaagacccacaccgatgaaccatgcagaaacagcagatgcggtcttaacaagtaatgtctggaaggaagcaataatactttcatttctgcttccaagtttcacttcaccataatcaatgacatcggctaacataacggttgtcgcacctaatgtcagacccgatcccattttgtaaagtacaccgcagactgcaataattactacattttgcggagcaaagaatccgctgataaccaatcctgcaagaccaattgccggactgaaacttgcgattgcaaatacctgttttttgctcaaatcttttgaaatcattgggaaaataaacagtgccgcaatttccgcaaattgagaagccgttgtgaagattggatacaagctgttgcttcctgctacatatttaaagtaataaattgcaataccacctgcaagctgaacaaccagattgtagcaaagtacaacaccgataaatacttttaactgatcatttccaaggataacatgaattgcatctttaattgttgttctttctgactttttatctgttgtttcataacaactgcggtcttttacaaaaacaactgtaataacagaagtcagtacaaagattacagcaattccaattgccagataaaaatatccttttgcatcatcgccttttcccagcatggaaaccagtttgattgcaaatgctcccattaacagccatgcaagactggcaaaaattctcggaattacagacatggaatctctctcttcttttgtacttgaaagagaaggaagcatagaccaatatgggatatcaataatggtataagacattccccaaaggatatatatcactgaaaaataagcatacatcgcagttcctgtcattccagccggtttgtggaacaagaaaataagaataatggagtttaccactgctccaattaaaatccatggtctgaatttaccccattttgttttagtgttatcaacaacaaatcccatcatcgggtcattaaatgcatcccagattctggccaccagaaacaggttaccgacaaacaaaggtgtcagtcctacagtatctgtgaaataaatcatcagaaaataagaaatgatggcatagcacaagtcttttccaagtgcaccgataccaaatgaaaatttactaaaatttgttaacttcatatgtgttctccctcgtaagttttattacttttatcattctccaatgtaaagaagcaggggaatgcttatctgcagtaaagcggacattcgcaatccgcttcgctacttgctcatgaacgcagtcgctttgcgatctgtcagtgggagctttcaactcccactgacagaagcattcccctcacccgccgcttagtgctctgcgcacttgaagcggtggaatgcttatctgcgttcaatttctttaaattggattaatgtacttgcataatctcctgtcagacaaaggtcaaaaccgtgctgcatcagatatgcaccactctttttaatttcttttgtttcaagaataacagaatataccgcctcttttttcaagcctcttaattttacagtcactttgcggtgtccgattttggtctgaggaaggaatgcgaaaaccagtccttctgcctcttttgtatattcataaagatgatagtcattttcagaagtattttgcagacggtagaaatctccttcctgaatgattggtctgattttcttataaagtgcaatcatttcttttgacagattgctatcttcctctgtaaatttcaaaatattacagccaattccgagtgttcccatcattgcactgtggaaacggaatttcatagaaatcacacgatttgaaataaaattcggacaatctgttacccaggcacgcattgccttgattggataaatataagaataactgtcctgaacagtcagacgatcataagcgtctgtgttatcactggtccagaaatcatcaaaaatcccaaggattccataatcaattcttccgccaccagaagcacacgcttcaaataatacatttggatgcttttcttttagttttttcacaatatcatagactgcttcgatatgtcggtaccagatatctttgtgaagattggtctgtgaaattggtctgtttgcatcccatttgatataatcaatttcatgataagaaagcaggtcatctaacatttgataaacaaaattctgcacttccacttttgtcatatccagtacatactgacctcttgaagtatcactttctcttgtatcaaagtgataaatccaatctggatgttcagcataaagttttgttggtggatttaccatttccggctctacccagataccaaataaaagtcctaaagattttacttcttttattaattcatctataccatttgggaatttttcttcattgacataccagtctcccagaccattttcaatgccatttcgttctccaaaccatccatcatccacaacaaaaagttctgctccaagttcctgtgctctttttgcaagcttcttttgttcctcacaggtaacaccaaattctgttgcttcccaggaattatataaaactggacgaagcccagctcttaagataaagtcttttgcaaagttatgaagattatgagacattgtttcaaatccactatttgaataaccacaaataattgcaggacttgtgaatgtttctcctgcctgaagcttaagacaaaagtcgtgcgcatttaagcccagctgcaccaacgtctcaccatacggtgtctgctctaccactccactgaaatttccggttctgcgaagcgcaccaaaatatacatctccacttgtctccgttgcatctttatctaaaataaaatatggattatgattgtgagaagagattcctcttcgattttcaattaaaatctttccatagcttaccttctgtacaaacctttgctgctcagcgccccaatgaccatgcacatttgtaaaatttaagtcttcatacggaatatgaaactgtccactctgtaactgctcgacctccattgcctcattggattcattatgaagcactacaaaacgctccatcaaatcatacttttcatacactttataatgtaattctattttcaaagcataatattgatccttcagttcaagaatcagctcatcatatgcttctgttttttcaatttgatatcccacatactcatatacaacttctctggttccatctgcaaatgttactttcagacaatgctctttataacgcagacttccgtaaaccggaaattcttctggagtaatctcatagaccgggtcatttgtagatacctctgtcaacaccggcatttcaaagtcctcaactgcttcaattcgctttccccagtataagtgtctcactaagccctggtcgtcaattccaaacgcataactattcgaaactgtttgtaacaagaaaacattttttgaattgttgatcacaatactcatttgctcttccccacttcttttcttttaaagtatcactatttttcatttcagtaataaatttaccacatttttttactttaagtcaaactctttttaccattgctttagtaaaaatttatctatttattttgtgaaatttgcacaataaatattattttttttaataacaaaaaagacccctttcggagtcttttctcttaacttttaaaatagaagctgaagtcccatcacaatgttccacatatatgcacatgtcttttaatccatcatattccctgtcaagttctgaagtatccatgctgcttcctatctgcttacgaatttcccgagcaaactttgaattcttcacaaatttgcggataattccctcaactgccgcattaatcctgtcctcattccactgtcttttataagtacagcggtgtccgttcacaagctttctatgtttgaaggcatatttgatctgtcttccagttttttcctagtgaattgacaaatgcatagattccataatctacacctccacgattttaagctatcccgaaacatgagactattcgatcactttttaacaaaaaatcccgaagttaagtcaagcggatattcgcaatccgctttcgctacttgctcataaccaaatagctgctacgcagcttatcagaaagggcttaccccctcctgatacaagcaagtccccaccattgcttattgctttttacaattaaagcaggggacttccttgatttggttaaattgccatcatccagtttttttccaactctgtatcttcattttcttgttcctgtaaaattcggtaaattgttctccaatagtgtttttttacttcctgacagattttttcgcaatctccctctttacaagctgctaaaattgcaagatgattttcatactggcgctccaaaatctctcctttatctttcaataattcatagcctgccaaaagattactgaaatataactctttccatgctttttcaagacgcggaagttttgacattatcactaactgctcgtgaaatcgattatcatattcaaatactttgtcaaatttttcaattggaatatgtttcatatgctccaaaatactttccatttttcgaatcgtatctttcggtatttttccatttagcaaacgtatactgacgatttcataatttgtacgcaacaaataagcttcataagaatccataagagaaaaccttctcacagaacaccccacgtttcttgtatactctacaagcccctcaatttccaactggcgtagtgcctcacgaatcggtcctcgactggtatgaaattcctgtgccagctccagctccacgatccgctctccgggacgaatctgacgcttcatgattttcgttcgaatagcatttactacgctttctcttaatgttttgtataataattcactcatatatctcctcttaccacaaagtgttctatgtgaattcgttaccactgtaaaatttatcacaaagtattttacatgaattttctttcactgtaaagttttatcacaaaaacatcacatttttttgatgatcttcttaacgatttctacggataaatccattccttctaccgttatgtgctcaaatggaccatggaatccatctccaccggtaccaagattcggacatggcaaacctcggaaactcagacgcgcaccatctgtacctcctcgaatcggagaaacatccggttctactcctgcttctttgcaagctgcttttgcatactcaattaactgcatacatggctcaatcttttctctcatgttacgataagattcttcgatttttacctctgcggttccttctccgtaaatagcattgatttgcgctactgcctgacgtagtttctcctgttttacatcaaataataccggatcaaaatcacgaataatatatttcatcacagcctgctctacagtcccgttaaattccatcagatgataaaatccttcatatccttccgtcttttccggacactccgcttttggaagcattccgtgaagttccattgcaatggtctgcgcattcttcataatatcttttgcgcttcccggatgaacattcactccatgcacaatgacttccgcaccggctgcattaaagttttcaaactgaatctctccttcatggctaccatctaaagtataaccgtaaactgcgccaaattcggaaagtttcaggtaatctgctccgcctccgacttcttcatccggtgtaaacgcaatacagagttttccatgaggagttttttcttgcatcagttcttccactacggtaagaatctctgcaattccggccttatcatctgcgccaagcaatgaagtaccatctgttgtgattaacgttcttcctttataactgcttaatcttggaaaatcttttaccgtaagcacttttccagaagtaccaagttcgacatctttcccatcataattttcaatcagctgtggctttacatcacgtccattataatccggagctgtatccaagtgtgcgattaagccaagtgccggaactgcctccataccctcggtagcaggaagatagccatacacatatccatattcatccatttttacgtctgaaagtcccagtgctttcatctcttctacaagaagcgctccaagatccagttgtctttttgttgtcggaacactcttgctgttttcatcacttgcagtccaaactgcaatatattttaaaaaacgttcataagctttcatcttattttttcctcttcattttcaattcttattagaaaaatacagcccggagttcaatgtccgggctgtttcattatcataacaaatttttattactgatgggtatatccaaagaagaagtatcccagtggacagcaatataaacctttgatgccatctgccagcatgtatttctgagtatagaagtaaattggagctaatacactatcttcaccaaccagtttatcttctgcctgatgtaacagttccatacgtttgctggtatctgtttctgcttttgcttgtgcaatcaggctatcatagtcactgttagaatactgacaatcgttatttcctccgccagtcagccacatatccaggaaggacattggatcattgtagtcagcgatccagctgttacgtgcgatagaataatctccgtctttacgtgtctgcaggaatgcagcccattcctggttgtttaatgttacggttacaccaagttcattttcccacatagactgcagtgcttctgctactgctttgtgagcatcacttgtgttgtacagatattctacaaccgggaagccctcaccgttttcatatcctgcttcagcaagcagttttcttgcttcttcacagttcgcttcatagtctgcatctgtaggtttataataatctccaccaactgtacggaagtcatctccgtcagtgccttctgcgtcatagataccagccggaacgaatccacctgcttctacctgtccggactgtgttacctggtttacaatataagtacggtcaattgccagagagaatgctttacgaactttcggatcgttaaatggctctttctctgtctggaaacatacataataagttccgatatagtctacgatcttcatatcgccggaagcgatcaaacttgtaatttctgcctgaggcgcatcctggatgaaatctaattcgccggatttaaatccggataacattgcgttctggttgtccattaatttgaaagtaatggtttccggtcccagattttcaaaatcatagtagttttcgttcttttctactacgatctgagagttgtgtgtccactctttcattttgtaagcaccgttagatatataagtatcaacgttgaatgtccactgatctccgcctttttcgatcatgtcctgacgtaccggcatcatagcagggaacgcacataattcttcaaagtaaggtaaatcatttactaaagttacttcaaatgttttgtcatctactgctttaacagccagttcatctgctgatttgttaccatcgataatatcctgtgcatttacaacacagtctaacatataactgtagtctgctgcggtttctgggtttaccagacgtttccatgcatattcaaaatcatttgctgttacatcctgtccatcggaccatttgattccatcacgaagtttaaatgtataggttacagttccgtcatcatttgctactttttcatagctttctgcctgtccaggaaccagtgcagcactgtttgcagtaccatcagaaccatttgtttcttttccactgtcttcccatttcatcagaccttcaaataagtgatgagccattgttccggcatctaaagaagtacttaatgtcggatccattgtctgtggctcagaagccaggtttactgtgatgttaaactctccatcacttgcggtgtcctttttccctgcgtcgtctgccgcatcttctttcttagctgcaccgtcatccgttgctgtactgcttccgcagcctgcaagcatagatactgtaaatgttgcagctaacaggatagataaaacttttttcttcatatcctctctccttttcttcttttattgataaacaggaactcctgcattatccatgtaagaacagctcgtttccccgtgttacttactgttccaaaaggtggcatgccacccagtgttctttttcatactctttaaatctcggcacctcttgcttacatctctctgtagcatatgggcagcgagtatggaaacgacagccacttggaggattcattggagatggaatatcaccttctaatacaattcgctgtcgatttttgctcacctgcggatccggaaccggaactgctgaaagcaaagttttcgtatatggatgtaacggattacggttcaactcataactttctgcaagctctaccattgttccaagatacataacaccaatacgatgtgaaatatgtcttacaaccgataagtcatgcgcaatgaacaaataggtcaatcccaattcctgctgcatatcttccagcatattaacaacctgagactgaatggatacgtccaatgcggaaatcggttcatcacatacaataaattccggatttacagccagcgcacgggcaatacctacacgctgctgctgtccaccggagaactcatgtggataacgattcgcatgctcagtgtttaagcctacatggctaagtaactctttgattctatcggttcgatctttttgattcggacatagcttgtgaatgtccaatgcttcaccgataatttctccaactgtcatacgtggatccaagctggcagatggatcctggaaaatgatctgcatcttccgacgatatggaagcatatttacctgttttgcttttggaactttcaccggatgaagaattccattttcatctcttttccaaggatcttgtccttcaaaaatcgtctctccatcatatacaatttttccggaagtcggattatataactgtaatacggtacgaccaaatgttgtttttccacaaccggattcgcctaccagaccaagtgtctctcctctttttacttcaatggagatatcttctacagcctgcactccaggtcctttaacacctttgattgggaaatattttttcaggtgctcaacctgaacaagagtatcttttttctcactcatggttgtctgcctccattttttcattattattttttgctgcttctttttgtgctttaatctgctcctgtacgcacagccaacatgctgatctgtgattttctcctaattctacatatggcggcattttctgtaagcaaattttcatcgcactttcacaacgaggtgcaaacggacatccttccggcgggtttaacatatcgattggtgttccctcaattggaatcaatcgctcatagctatccgcatcgacacgaggcatagagcgaagcagtcctctggtataaggatgacccggcgcatagaaaatatcatctaccggtccctgctctacaatcttacctgcatacataacagatactttgtcacagatttctgctacaacaccaaggttatgggtaataaaaataatacccattcggtttgttttctgaagttttttcattaactccagaatctgcgcctgaattgtcacatcaagcgctgtagtcggttcatccgcaatcagaagctttggatgacaaatcaaccccattgcgatcataacacgctgacgcataccaccggaaagttcatgcggatactgcttcatacgtttttctacattgttgataccaacttcttccagcatttccatcgcacgtttctgtgcttcttctttgctgatatttttatcatgcgcttttaaagcctccatcagctgatttccaatcgtatagaccggattcaagcaggtcattggattctggaaaatcattgctacttcgcttccacggaaatttaccatttctgccggagtttttgccaatacgtcctgaccttcaaatgtaatagagccaccgattacttttcccggattttgtaacaatccaatgatagaatatgcttccacactctttccggatccggattcccctaccacacccattacttcattataatctaaatcataactgattccatttactgcttttacctctcctgccggagtgaagaaagaaacctggagatctctgacttctaacagcttgtcagttttattattctgttccattacgtctctccctttcttattttttcagtttcggatctaatgcatcacgcagaccgtcaccaaacaggttcaaagacaggatcataacacttaagatcactgccggaatgagcagtcggtacggataggtgcttaatccgcttaatgcttcggaacacatggaacccagactggtaagcggagcagatacaccaacacccaggaaagataagaaagattccaggaaaattgcggatggaatctgcaagaaggttgttgtaacaatctgtccgatacagttcggaagcagatgtttactgatgatacgtccaccttttgcgcccagcgctcttgctgcagttacatattcctgctgttttaactgtaaaatctgaccacggataatacggctcatggttacccaatataacagaccaaatgcaataaacatagaaatcaggttcggtccaagtaaagttaccagacgctgtaaaacaccatcaccagaattctggaactgttccagagccggttttaaagttgcagagagcaacaagataatcagcatctccggaatagagtaaataatttctacaattcgctgcataacactatcgactacaccaccgcagtaaccggaaatggatccgtaaattgcaccaatgatcaatactaagattgctgcacaaatacctacgataatggatactctggcaccaaccataacacgcaccataatatcacgaccctgatcatcggtaccaaacacatgagggaatactttctctccggctgctttcttttctaattctgcattcgaatatccaaacatactatgtttgattttcagtgcttttgctgcatcttcttctgtcacttcttcactttcagcttcctgctgagatacatttgcttttgcacgaatttttgcttcatccacacgagataaggtttcacctttggcttctgcctctttacgtgctttttctactgcttcatccggtgtcaggtttcctgcaccgttatgttcttccatataagcattgattttttctgttctttcaggctgtaatgccaaggatgcaacgcttcagaaccacgaatctgctgtttataagtatatggtacaatagatggtcctacaaacgcaaaaagcgccagcaggataataattaccaatgcaaccattgcaacggtatttttacgaagacgtctccatgcatctttccaataagacacacttttgcgttcctgaataaaattctctttctcttcagaggttgccggttcaaacgcatctgccggcaaatcattccactggaggatatcctcaatattcggctgaagagaacctggtttatgatatcttttcttttcagacattaccttaatttcctccctttgccagattgatacgcggatcgaccagtttataacatatgtctacgagcaagttcatgatgataataaatgctgccaggaaaatagttgttcccataattaacggatagtcacgattctgaattgcctgtacaaaatatcttcccagtcccggaatagagaatacggtctctacaaccaaaccgccgcaaagtgtaaatgcgatctgtggtcccaaataagtaataaccggaattaatgcattacgtaatgcatgtttgaaaataattttactattcttcaaaccttttgctcttgctgttttaatatactcctgattgattgcatccagcatagatgttctggtctgtctggacaaatagcacatcggataaaaaccaagggctacacacggcaacacataactttgcggagtaccatcaaacaacgccgggaaaactttgattccctcaacaccaccacagaatgtatgtaataataaagttgcaactacaaaccccggcatggaaataccgatagtacacagcactcgcagaaaactgtcaatccaggttcctctcttaaatgctgcaagacatcccagcggaatgcctaaaagcactgcccataaaagagcaaggctacctacttttgcagataccgggaacatttctttgataattcccagaaccggacggttcttctgcatcttgatggaagttccaaaatctccctgtgccaagtttttcagatacttgcccagctgaacatacataggctgatccagtccgtattttgcattcaatgcctggattgtcgcctcagacggtgttttttctgataaccatggattacccggaatcgcattcatcaaaaagaacgtaatacaagcaacaagcagcaatgtaacaaatgccatacagattcttcgtattgtgtattttgtcatcttctatacctttcctctctttctcatctctcctgtcgatgtaaagcggacattcgcaatccgctttgctacttgctcatgaacgcagataagcattcccccacttcaagtgcgcagagcactaagcggcgggtaagggggatgcttatctgcgttcaaattgtaaattgtcgacaatatgacaatattatacccattttaacgcattaatgtcaagataaaacaactatttttatattttctctcccacacaattgtgcgtatattatggacatttacgttttataatctcatacggctcgctataccagatttttggctcatctgcttcatttttttctaaaactttcctcattaagccatctattttttccacctgatcttctacattattatccactgtcccatagatttcgccacttaaatccacccctgcatctctcgaatataaaatgcgatatgataagacaatctctcttccggcgtctttaattcatttcccaaaatttttttaatatttccaatccgatataatacggtattacgatgtgtatacatttcagaggctaccgcctgaatgctcccattgtgttttagatacgcgtgcaatgtttccacataatttgcatggtatctgcggtcatgttcttctaatgctgccagacattccgcttccaattcttttaatatccctttgtcctctaccatatacagtaatcgaaataaaccacattcatcaaattttattactcgttttttttgcacgatcgccatatgcgctgctacctttgccctatgatagcttaccgaaagtttggaaatatccatacacctgcttccgactcccacgcacagtttgagctccggcatacgcctctctcctctttttatagctccttctattaattggtacaaaaattcttccggaaccgcatttgctactaatacaaaatctgaattgtaataaaagaaactggcattatgtgtaatatcttccagatacacttgtattcgataagacaacttctttctctctacggtatccatagcatccaacccttcgcaagtcaataaaaacacctgaaagcttccatctacatcaaaatgttgtaataattcttttcgatattcattctgcttctccggagtctctattaccttaattaaagcggaagcaatctgctcatcggtgttatcctgcaaaaatacatgaatactaaagtcttttatcatatcggataagtggacttcccaaggtaccgtcaataatggaagatcattttcgtcacagtatgcaatcaattcttttggcacttcttcaatatactgccccacattaataatcaaaccagaggcatgaaactggttcagctgccttgccaaatgcatccagtcttctttttggggaaatcccaacccggttgtcactgcaagctcctttccccaaaaattttgtataatcgttgttccctccagaagatgtacccaactgatggaattcgcccagccattttttccagccaaaaatttcatttcatatcgcttttctgcgatcaatatcatatcttctattgtaaaactcatatacgctgttacatcccttcgtcttttttatatttttttattgtaacatagtttttgtgctgtcagcacagatttccactccaatttttagagttatccgccatagcttttctccatgtttgtgctaaaatatagataaattaaaaaatgtttaaaggaggcataattatgagatttgaagtttatacaaattcccaggatacaattcttccggaatggattcagaccgagcgttatatgtattgtgacaattttgtaaacgactatatgaaatctaatcgttttagtcttctttcttttgtcagacatctgtttcacagataatcatatacctctctttttgaaaaaaaggacatccgattcgggtgtcctttcttcttttggatgctttttttctacatccgacagttttctatttatctaaaactgcaacctgaattgcctttactgcctcctccatgtatttgacatcttcctcacatagcttaatatccagacattttacggtatcttctacactggaagcttttcgcattccaaccagaagactcattctgtcatactgagacagtgcccaggattctactaatgccgcaaaactgcaattgtatttttcacaaagcaatctccaagtttcaaaagctctgcgcaacccctccttcttctccggagctgtccaaggtattctggatcggatgtcagtttttgcaaattcacgttccataaagaccggagaagttaagaatccttcctccagtacaccataagtttgaaataccgtattatactttttacacagttcaaaatattctctgccatggaaaggagagagaatactgaaaaattcttgcacaacagatactcttccaccagcttcctgatatgcagccaaatccgccggctgactgttagaaagtccataggtgcggatttttccttcacgaaccaggtcttccaaagctccaaccgtctcctctacaggaaaactgctgcaaacataatgtacaataatagagtccagataatccgtttccattcttcgcagcgaatcctcaacatcttttttcacagctgctgctcgggtgtcattatttacggtataaccgtctcgttcgtaatggaaattaccaccctcatctctccaattcaatgagcatttggtctgcaaaataaaatcttctcttcttcccttaagcgccttaccaagcagttcctcacttacgcctgtgccatacaccggtgcggtatcgatgtaattcacgccatattcatggcaaacgtcaagcagacgcttcgcatcctcaactgtagaatctttatctgtccaaacacttccgcccccaagtccccaagtacctaatgcaaccacagaaacatcgatatccgtgttgccaagcttttgaaatttcattgtaattcctccgtttttgttgttttctatgctattgagtaaaaactattaagtctatccaaaagttattttctatattttttgtagacaacagaccgtttcgactgtgttttcgttgagcaaccgaattgcttcgccttcaaaaccttcatattatttcttcaatcgtcatctcatatacttctgttacttttttcattgcttctgatatccccggctgctctccggtcctatctctcaaaagttctgttaactcgttactaacctcatacagacggtcaaaagaaagattctggcaaacccctttcagtgtgtgtgcaccgcagaaagcatcttcaaaatttttattttccaatgcctgttttaactgtagataactctggtcttcaaggaactttaatgtaaatctctgaatcagtgcttcgctgtgaaggcgccccaggacagcttcatagtttcctccaatagcttcatagcactctcgcattgtcatattttagtcctcctgtcaattgtattccactaattcatgaacctctgctagtcaattatatacataccttaaaatcgtttttataacttcatcaatcacaatcggctttgacaaatgtgcgttcattcctgcatccagtgatgcctgaacatcttctgcaaatgaattagctgtcattgctataataggaatgttttttccatccggtctgtcattcatcgccctgattgcttttgccgcttcataacccttcatttcaggcatcatgatatccatcaggattacatcaaatgtgccttccggatgaaatccgcaaactctttatctcgtgagcttccgttcaaaagtgctacacgcataccattgtaagtactgtaatcgccatccacaatcgtgctgttgtcactgcggacggtcagcatcccataattggttccgatcggacgtgaaaaatcaaacttttcttctctgtccggtgttttgcgggcagatgttaccatatcaatctcgccatcttcaagcatctgctgcatatcatcccagctctgatcgtatccgacatattcgtaatctacatcccaataacgggccatcaaccgaaggaaatcatagccataaccgctgcggttcccctcttcatccatcatgtgataaccatccatggcaaagaaaccgactttgacagtttcatgctgcgaactgtcctcggctgcatatgcagtctggggagaaaatatcatacacacgcatacaaaaaccagtaacactgccacatatttctttgctctcgaaatcatattaaatctcctgtctgtcaaatatatttctctatacgtctccttgtcaacctcctgttttaataaattttcacctgtccctactgcttctcaattcttcgcatatagtctgcttgattgttttatcatctaatggctttgcaagatgtgcgttcattcctgcttccatacacctttcggcatcttccctgaatgcatttgcagtcatagcaatgatagggattgtttttgcatcttgccgttccaggtctcttattgttcttgcagcagtaagaccatccatcaccggcatcataacatccattaaaataacatcgtatgttcccggttcggaagcttcaaagtgctgaacagcttctaaaccatttttcactgtttctactttagccccattttccgtcagcataaattctgctatttccacattcagctcattatcttcaaccagcaatacccggatatctgatatatctgcatcaaaatcttctttttcttctggccgtacattcgtatcaattttaaatggaagtattacagtaaaacagcttccttcaccaagcttgctttcaactgttatggttccgcccatcttttctacaagttgtttcacaataggcattcccagacctgtcccattataatcagaacgtggggaattatctgcctgtacaaatggagtaaacaattcattttttataaattcttctgacattccaattccagtatcttttattttaaattcacatgtcatatgatcttctgatctttcaatcgttctcatactcatgtaaataaaaccattcaccttattgtacttcatactgtttgtaaacagattcatcaatatttttttcagatgaactgcattgctccaaacatatataccactgtaatcatcatgttctcctataacatgaagtcctttttcttctgcctgaaaagatagtgactccgtgatttcctgacatacctgatccagattgatggattcatcactaaaaaccacggtatcagattctaactttgccatatccaaaacatcatttaccaatgataatagcagtttcgaagactcatttattttattcaggcaatcttttgcccgctcaccatcatttccgcttttttcaagaattgtaagcatgcccataatgccattgatcggtgtcctgatgtcatgagacatgttatttaaaaaggaagtcttagccttattggcactctgcgcttctgcaagtgcactttgtaattcctgctgtttttcttcaagctcctgattcagcttcaatgcctgctcagcagacttcttggatttttcttccgcacgttttgattttttcaaagaatcaagaattatacacagaacaacgaaaaaagaaattccagcgataagtgaaactgtcagtaaattgtcctgaataaaatccttcgctgtaacttttcgtgaagaagcattatacgaaactactgcacctgaaaattgagctgtaggcatagatgtcagtgttttattcagaatggacaaaagaaccggttctccctgctgaacagcaaatgaaacatcagcttcttttgtcagaaaaacactatgaagcttattatttttcaaatagtctgaaacagtacctgaattgcttacaatacaatccgtctcccctttctgcattgcttttactgctgcatctgatgtctcatattccacaacctcccattgcggataattgtatgaaagatatgccttcaatgcaaaattatctttttcaacggcaactatattctctttattttcatcaaaagaatcctttgccgtaattgctgccatattgagagtcaatagcgtatccgacaaagcaaatccatttgtttctgcaaagtatggattctggtttgcatgaaaaatcaggtctatttttccatcctgcaatgcctgaagcagttcacttcttgtatcatatccatttaattcaaattccagagtctgaccttgcagacaattttctgcaagatccacataatctgtgataacacctgtcaatttacctgttaatggatctacactgctgatacctccatcctgattcagatacccaatcctgagtgcaccatgttgcccgatccactccctttcttcttttgaaagaaaggagctgctctgtgcagaaagataacgcctgtagagatcatctgtgtaaaatgggttgtcatccttgattctgcgcatagcactatccagtgcttctttgatatccggacgttctggatttataacgaaatagatttctgtctctccaatacttgtaatcggtgaaatatccgattcttcccaacgggattcttctaccgaaacaaagcagtcaatttcgtgtttcgacagtttgtccataacttctgcggtattagaaacattgatatgcttcgtatgcagaccatattttgattcccattcattaagcacatcctccactatattatctttagagacaccaatattttttccctcaaaagaatccaaatttcctgctgtaagatccatattggatgcatccgtatagatgtaatatttctcttcccccataggcatatcggaaaaaagcatattttcagcacgttcgtctgtataggaaatgccaccaagaatatcaatctctccatttttcaactgtgtaaagcagtttttccaatcacttgttatgtatttatatgtccatcctgcataacctgcaatatcttgaagatactcataaccatatcctcttctttcccccttttcattgacggtattataagtttcttcaaaagatcctacccggataacattgtcagagttttctttggcaaatgtaggaacggataaaacaataaaacatataattgtgcaaaatataatgtaacaaaatttgaaattcattatattctgtactaatttgcacttcttcatctttctcccctcctctaggctacagttgcttgcttccagattttaattttacattcattaattatcaataacctccccgctatttttcacaatatttttccaaacagcttctgtattacttattcaagtgctctaccagaacaaagcggacaagtccgcttcaaactccctcaatccctcaatccctcaatccctcaatctttgagggacttgttacgctttgcgtcccagactttcatctggtttgccgatttccatattatagctttaatacttatgcaaaaaaactggttttattatactatagcactctactgtacacaagaaaaaacattaccgttttaacgcctgaaaacaaaaaaagaacagccgatacatatactcgaactgttcttctacttccgaagtccacgcagcattgacattactgtttcctgcttcttaggttgacggctagatacgcattagagatgtctccattgtaatgctatttcttctaatggtaaccatactaactgttctccgtcatcagttttactcttacacaattttaaatcttcatccaaaattttcataatcttgttgcaccaaaatcatttcaatatcgtttttttattaaattaaaaagtctatctgcagtatccggtcctgttttgccagtttgctttgattgattgactcctacaaatgaattcttcgaaagccttgttgcaaacacgagataatccttaaacaactcgacagcttcattctgaataacatttgcagcgataataacgtcaatgcctggattatgattctttaactcatcaataatcctcattattgattttccagtattaatcacactatcaacaataactactctctctgtattaatcacaggagcatcatcttgcttcgggttcatcgaataaaaaatgccgcctgctcccatatatactccgtcaccaaaaaacctgccacctcgttccaaaactaagattgatgtatttttctctgggaatacggtagcaatgcgccttcctattttttctcctaaacgcacatgtgctgctgccagcctacttccacttattcctgaattcgatttgcagatagcaatatcagcttgtacttcttcgtcctcatcagccaatatcaccaaagaatgatcgtaaatcggcaccaagcctgataagctttcattcttcaatgatctgcttattcgcttaccaatatacagaaatcctttatcagcctcgcgtaacatatataaatcaatcttgctatctccataggcaaaaatagtgtatccatgttctcgcaattgctttacgacataatacttaacatctgcacttatgtatggactagcaaatatagttccaagattcttagcattagcaatatcgctccacaaatcttttattccagaagaaagcacaacataattattcgatgcaactatgtcatacacttcattattaattgttatctctgcaattttagatttgtcaatagacgcggtttgtaattccttttcaaaaagaaatgattgatagccagtataaaaatctccatcgaagatctttgtcttgccattacaacagaacctatatgaatcttgaataataatggttttatctccgtcaaccatatacaagatatcctgcttgttgaactgctccattatttgattacagatatctgtcgctaaatcataggagctgaaaccttctcgaagtaaagataagaaatcaaaaaacttattctgttcttcttcattatcacttacaacgtaaaagtccttatttcgcctatgacattcctctctaagattatttatttcaaactcctgccattgtcttaacgactcaatggactcgccagcaaacttagcatttttctctgacaaagcatatctttccttaagattttccggagaacaatacagataaataaagatgtcgtacaaatctccgtcagcctcagtaaatgcaacagtttccataaatgaatagtgtccatctgaaacaattacttcatcattcaaaccattaatatattctgtgtatttaattctaacttgatgtttctcttcttctgatagttccaaaaaggaaccaccgcaaatacgtctcaactcctggctgccattaataacctttgcatcagttattctatccatcaatgtacttttgcctgcacaaggcattccatataatgctattttcaaccagtaaacacctccttgaaacaacagtttctgtcaaagtcgataacgtcaaaactgacctcatttagaggtgtgtcgtaaggcattgaaaaaggtaaatcaatacaattaccacatatgaatatctttccatttgcgtaaaaaatattatccattcctgcaccacacataccaccatacatggtacagtcgtagccaccagttctaacattcaatcgttccatcgccttattcaagaacgcattaaaatcaggtagcgatatcccctgttttccaatcatcctagaaaacgtaatcctattaccaaattgttcaaagaactctatggtcgcttccggattatcaattatctcttttccaacagtacaattcatagaaggatacttcccattcacttctttatataaagctatattttccatcactcgctcatgagttccacatctatacttgtcgtgaatagcagagattccatctactgaaaagccaacatttacattgtattctttgaagaattctaacttctcacaatcaactaaaagaccgtttgtaatggtgtacgcagcaattcttccagatttcaaataatcgccaatatgagcgatatactgcttaagtttttcataatctaacattggttctccattacccacgaaccctaacttaaacaaatcaatatcgttgtcttcaatatgcgaagtaataatatcaagaatagtaattacatccatattgtcctcttgaatgtaattcttcttctcctgaaaatggcaataagtacaattgagattgcatcgattatttatcgatatacaagctcgtgttaccatcttctattcccccttttctgactattcttattgttacctctattaaacttctttcttgtaggaccagattcatgatactcactaacccaatcagcagcagttttaccatcaatgtcaacgatcttctgatcagctcctgcatcaatgagtatctttcgaatatcccaagtatgcttttccttattattttcaaagtgaccattcatgcaggccttcatgagcgcagtaaatccattagcgtcctgttggttaatactggttctttcatcctcacataaagcaattacaaaatccttctttccctcccaggcagcaatcattaatggcatattgccctcattcttctggcgtacttttccggcatcaaaaggatttctacttccaacattaggatttgccttacactctaaaagcaaaaacataaacatctcatactccttcatctgcactgcatgcgatagagcagggaaatatctacgactgcaatcacgcttattcacatctgcaccaagctgaatgagccatttgattttttcttttctttgctcaattgtggccctattatttcttacagcagaaataataagggtatttccatcctgaagatatgcattaacttcgtctgctgtcggttcttcgcattcctcatatgaatctgcgtaataagcgtcaattctagccaatttagtcatattgataagatcctgcttagtagccatatattctctaagatgtaatgctgaaacggattcatgccctttaagatatgctgaataatcggtgtcctctgttatgatatctactttgcagtgatatgtatcagaagcctcctgtgcaatatatattattttgcaatcttcgttatcttcatcagcatcgccattatattccataagaattgtacgagaaccatagctaataccacgaataacttcccaagcctttctcccaagagaacctgagttcttattctttatattatctaattcatcaacaactacctttggaataactaccttgctatattccttgttcagttcatcaattaactgtgaattcttaagtaacgctgaagtatctggaactgcaaccttctcccctcttaaaaattgttcggtctgtgattctgacatttcaaaaaccttacaatattttcttgccatttccaatagagttttttctgcagtttttccaccttcaacacgtgaaatagacgacttgttcataccagttcctggttccaagccctctaatacatcaatcttctttgccatgccatccatggtacagccattcttttcacgaagctccttcaatctcgaacaaaggaaagctatctgattatcatttgccataagtaacgcccctttcataggtatgtatgtaatttgattatttgctttatctcatactctcattatatacctcgttatatttttcacaacgaaaaggtgtgtttttgcaacaaatattcaaaaggcgcaacttatcacttcatttacttaatatatgcaactaaatgaagctacttgcagcaacacaaatagatcagttgcattaaccagctattcaaatttctaaatgcatcactacttcttataatatcgttgtctattctccgaattatccgctctgtcatttccatctgtgtcacacttcggtccaacttgagccgaagtcatatgatttgcttcattacctgccagcacttctgctccattatctgacagtgaatcatccgataaccgctttccctgatgtttcatggcatccagcttcatcttatacgcaaatgctttctcacttggcttcagattctctctatgcaggttagagtcaaccattgccacaactgactgagcatcatccaattctcttatcacaaccggaatcttcgtctctcctgcccatatagcagcttccattcgcctgtgaccggatattatctcatatccatccccataaggattcgtccttaccagaagtagcacaatcactccttctttctcaatactcttcatcagctcgcataattccgtatttacttccaccttaaatggatgattcttaaaatcatgcaactggtttatttccacattccgtatcgtctccataaaatcgcctttctcgaatacatcgaattcatctattctgaaatccatctgatacgatgactttcagatacaaagaaagaccgctcactttcaatttttcttgaaaatgaacggtctttcacgcttctgttatttagttgaatgataaatgtattactttctctttgatgtgtttctgaagccgcaatccaataccacagacacgtttactccatcagaaatagcctttttatacgtttttcggtcactctggtcaaacctgaaaaacctctcaaagtgcctaaaatcaaggattcttacaaatcggtccgatgtagtgcaactattgtctctatatgcgtctgcgtttctgcagatacttctgttacgattgtttcctgctctgttgctgctgtactttctgtctgtgccggtgacggtgactcagaaaaagtctggtctgctgcaggtgctccggagcatgctgccatagacattgccattacaacagcaagcatacccttcatcatactcttaattctcataatcgtttctcctctctgaaacatgttttgtttttcctctgcttcactatacaataccgttgtaaaaaccaatgtccaaagtaggaaaaatttgagtaaattccgacacttattttatgcagttctatctttatgagatttcatcaacatcataatacttaaaatcccggaagcaggcacttcctcctgtttcctctgccgcataacagaacagaccaaaccggcaaccagtaaaatgatccagtttgaagtacagcttatgcacggttccgatgggtagccagtctcccttatttacccggtaatagcagcgtgcttcatccttcatgttacagaaatctgcttcaagacgaaaatctatctggtgtgattcaacaacagttccttccgtcatatccaatataccatcttcttttttatccagcataaggacttcatattttccatgatgttttgtaatgccaactgcagcataacagctctgcaacgcacacaaacctgcgatatcgccctctttcaatgcagaagcatcaacagtaacctcagctgcgcaggacggataactcatcctttgcgtaagcgtatttactgcctgtgtaagctctgtacaaacttcccgtgttgtaattgtataggttccctgcaatgcatccagatgatagtaccgtggatctggatcatgattaaactgccagcgcggaagcaacccattacagaaatcatcacttcccactaatggctgataaatatatcctggtctggtactgtgaacctctatttcttccggcacatgtccgttctgtccaaaaaacggaaaatgatccttccaggtaaccggaagcagaataggaatccgtccaactgctccggaatcctgaaacagcattgcataccactttccatccggcgtatccactattcctccctgtgccacgccctgtccacaatatccacgatcatcacaaagtacatctccacccgtgaattctccttccagagaatcactgtaaaagcatgcttccgtccgcatccagcggtctctcagggaatgaaccagaaaaatataataatagccgtttattttttgaatatgagaaccctcatagcctagctccgggttcttatgatcactgactaaaagacgatgtaatccgtccttctttggtgcagtcaaatcttcattcaattctgtaatccagatttcatcatttccatatacaatatagtttctgccatcctcatcaaataataaagagccgtcatgataaaagccttctatcagctgctttttccatggaccatctattttttccgaagtatacaaataagtcttacgggtatcatttgccacaaagcagatataaaatcggccttcatgatagcgcagggaagctgcccacatgccctgtccgtaaatattctgaccgcttttcagttgctgcgcatccgtatgatccaacgtctcatagacataagtcacatgctcccagtgcaccagatcaaaagactgcagaatctcacagcccggcataaagtgcatggttgtggataccatataataggtgtcttctacgcggatcacgtccggatctggataatccaatcttgttataggatttacattcattgtttattcctttctgttttatctccatattctttgttctattctatttttactattttatctttgtttcttatccgtctgccttttcatctcttctctgccccatttcactattgctaatatcacaatctcacagtaaaatataatcctgtctttgacagttcaataggcaaaaaatcgctataggactttaaacttaaggcttgtagcgattttggttttcgttttacaatgtagtaatttatctccttttactaattttttgaatttctttcatctttcgtttggtaatgaattgataatccgtgttaaaaccacttatatcatgaagcgtatctgtaagttttgatcgtctgtaaaggggctggaactaccccaaccgactaacgtgagggcactgaaaaactgtttttacatacaatatatagtagtgtaaaacatataagtatgctttaccttgtaccgttttgtgtaaaataaggactttttcagtagcgtcgactcgtcggatggggttttctgctctataatagataaacgagagcagacagaatggcatttatatcgaatttgaaatcatatttatcccgaatcttacggcaggtcttgtctagctgcaagccatagtaaatgtattgtagaaagagataaccaccacaataaaatttttgctggttgaaatcaagtcttcggtcggcatgaaatgttatctgcacagatttctcagcctgttcctttttatatttttccgtttcgagtcgggcttcttcacgtgcccaagccataacatcatcgcgtgttggcccatgttcttttaataattcattaaacacgcctaattttctgacagtggcagaagtgctttttcctttgctgtttttaaaacttttggtgatataaaaggattctgaatttttctatttgttcgttgtaactctcataatttctccatcttttttagtatagcatactattaagagaattaccactaattactactaaataaaacagaaaatttgacataaaaaatgcaggtagatcaatacctgcgaccactttttctaatattcaactgtcaaactcccaaatacgaagcatccgtaaacccgaatgtttcagctattaccattcatcccgatttgttttctcggctgggcatcttgaaaaatgccatatagtgcttgcatatttcacttgtatagatagcaattggggtatgtgtttgcggacacatacttggaggagtctgtaaattttttatcattcatgccttctaatttttctaatacctgcccggcaatatcttccatatcgctgtcctttatgtacggcattatccgtctgatttcttccatcatcttcattctgttctgtgtctcaaaaacacacatgaaattgatttcttctactgtgaatttattcatcatcctatatccccctatatgaattttttggtttttccagttccttcgtatccttattgtttccctgtgttgcttccttctgcttggctgccagtcgctcctttaaagaagaacgtgcttctgacttttcctgctgttctttcttttcttcctcacgattgaattttcccacgccattgttgagcctctcatcaatcatgttataattctgctcctccagttcctcaatcttagcaagcgacttgtattctgccaatttcacaagcagttcctttgcctgtctctcactgtcctcgtctattccttcgtcaatagataattttaatgtcactgccacacaggacagctttctgtcagtagtattaaaatatcgctgccagattttgtttacaaccagaagcaaactggatgaatactgtactctgccattaaaagaaatagaggatatgaacgctctcttccagctgacatcagtattttattcagaggcagacacgtaccggccaacagttgaaaagatcatcgaaactgttcactctcatacttttgccgtggaactggcagcaaaacttctggaaaatggaatctcaactccagaccagttattaacaagacttcaggtggaaaaagcatctttccataacgaagataaaattaaaataatcaaagatggacaaagcagcaaagccacctattacagtcatatccatacgctgttttcgttatacactttatctcttaaacagcaggatatcatgtgtaatatgtgctttcttccttccaccggtatttctgcccgtatatttgccaaatggctggaactgcccacactaaatgagatcaacgatttaattgagactggttttgtccagacaacaaaacgtcgcactatctctctgcatccgatgattcaggaaatcaccctttcagagacaaaaccatctgtaactcgctgccacatattactggattctttacagaaaatatgtttaatgcatgggattgaagttgattattacaagaagctgttttagacagcaggaaacatcatagaattgattgaaaaagatgatataccaaaatatctactttttctggaaaatgtttttccatatatggataattataattaccagaaaggtatgaaagcaatcattcaggaattgaaaaattttttgaagcgtaaagacattggcaccgattctgaccgggcattgttactggattttcaggctactcttgaaatcaagccagaaaaagcaataaaactggaaaaggatgcacttgcccagatagaaactatcactgctgacaatgctcgccttgtttccaaccttcatgccaatctcggtggactttaccgcatgaacggtcatcccgatcttgcaagagaacacatggaaaaaagtatctcactacttgaccaatttaacctgcttcatataaatgacagcatacctcagattgccaattatgcaatgttcctagcagaacagcaggaacctgaaagaggaatctccaaattacaaagattatccggcatcatcaaagaatatcattccgatgactgtctggattatgccaaagtacaggaaacccttggaaccatttatctgatgactgccaatcttccgcaggccaaaacacattttaaaagagctttcaaaatatataaaaagatctgagctgatgaaccagaaatgattaaagcaaaatattaggagattcaggagttatatccacagattggattttccattggaaaaactctatctggtcttttaacataatacgtgcaatttaaggcgggcaacttgcccgccttaaatctttaaattatgcttgatttttccagaaaatattttacttactttgtttttcatgagtatgaatacaatttttacttatttccgtatctgcgaaaactcttataaataaaaggcagtaaggctattgccatcacggtatacattaccattacaagcggaatttgtcgaaatacacaattcccaatctgataaataagtgggacttttacacttgcctgtacatttgtcaaaattgttggtatcaaattgaaaagcgttgtatacccagaaagtgcccgtcctataaatggcaataagcaatataaaaagaacggaatgcaaacagcgacactaattgtatgcattttagccgctactaacatagacactacagccgccagcatactggctataaatccacatacaactgtcaacaaatagtattgtccatatgacataatgtaaatactatacgcctgatacatttgataaggtgtattcataccactggttcccataattccaaaacaaatcacactaagtaatataattcccatacaataaatcataactgtcgtagctattcctgccagtatttttattttaacagcttttgtacgtccatactttgtagagaaaaatactgcatctgcttttgtctgaaaatcatctgcaaatattccagcacaaataaaaccaactatgattgacagaataatagaatacgtttctacatacataatcatagtatcccacgaactataagattcgtattctactggtaattttatttcattatatttcttttccaagtattttttctgaacagaagtctttccatattcttctgccatcttttccatatttttatgataagtgtcatagaactcttgtatattttcttctgtaatttgattcagaacactttcatcatattctgcatccggtgttgataccgatattataaaactcctaatatcatctatcggttgtaatgtcgttccataaatcgcattttcttctgaggattgtgtcatcgcatttttattttgttctataacttttccaagttcatcttctgtcaatgtacctttccatgctcgtctgttatctgtaagttttcttgttgccataattccagtactagcatttccattctcatccacatagcgattacttgtaactgcaaatccgctaaaaatgacagcaagtatcaatgccaatccgattgcaaatacattaattttctttgaaaaaactcgttttaattctaatttaagcatcttgtttttcctccgatttttctccaaaataaaatagaaatgcatcttccagatttttttctacagccacagcatcttctgttggcttttctattgaaataattctaatctctgctccggtttttgttgtttttatatttccaaccaaatattcattcatatatttgtctatcatacttctcgaaacattacattgccataccttttctttcatagaagatactaaatcttccgcagtacctgcataaaaaagttctccatctttcattaacataatgttattcgcaatgtactcaatatccgatacaatatgtgtagacaagagcaccaaacgttcttccgacaattcactaattaaattacgaaaacgtattctttcattcgggtctaatccagcggtaggttcgtccaggacaagaatttgcggatcgtttaacatcgcctgtgctattcctacacgtctaaccattcctccagacaaattcttcatttttcttttactgaatttttccattcctacttgatttaataattgcttcactttttttctggcaaacggtatttttaacccttttatagaagaaatgtacatcatgtaatcatatacggtcaaatctgggtaatatccaaaatcctgtggtaaatatcccagaacttctcggtattcacctcctagtttccatatatctttaccattccataatatttgtccttctgatggttgaacaatcgtacaaagcatacgcattaatgtggtctttcctgctccatttactccaagcagtccataaattcctttttccataacacaattcactttattaacagcatttacttctccgtattgttttgttacatttttaaattctaatttcatacgtgtaatcctccaaaattttttcatcaaatagcaatgacttctgaacaaaaaaaataaaatatacaaaagtcaatatcagcatagccacccataccggagttacaattttctgataaataacatcatttgcaacaatcatcatccataaaccaacccataccagacaggaaagcactgctatatattctgatttttcccatctgctgtacaatacacgaaaacatatacaacatgaaacatttactggaagcaaaaaattaaccaccaaatcacttaacgagagtattgttgtttgatatgtaattgccaaaaacaccataacgatcaccagatccactactccaaacattaacattcttgctgtacaaatctgacgcagtgtgtaataagacgcctgctcaatttcaatcgcaccatttcttctgtttttccaaatttccgggacaatcagaaccacaaatattgtggcagatattcccataatcctcatcatatcttttatgtctgacgtataactactcaaccatatccatagacacataagaatacaaccttgtaaaatccaccatcttttttttatgaattttgtctgctcatacaaaaattcaaaataagatgttctatgcaattgtttcgataaaaccgactctgacaaaatattctgacatgcttttactgttttgttctctgcttcagtccttacatacttttcttcaatctcctctttatattcctttatttgttgcttataattcttcatcttttttcacctccaactctttcattaaaagttcttttgcttttccgattcgatattttacaagagaaagtttgatatgaagtaattctgcaatttctctttgcttcaattcctgaaaaaaatataaaactgccgtttctctaatttcttccggtaactttctcactgcctgttcaatcgttaatcggactcctagctcttctacatgatttttactacagtcctctgattttagcagttcctctgatggaatatcttttttctttttgtaataatttttaacggtatttccggcaattgtataaagataattcttaacttttccatattctttatatctatataaattggaaaagaaacgtgtaaacacttcttgtgtcaaatcctctgcctcatagggatcattgatatgtagcaaacaatattgatatatgcttgagtaatattttttgaccagtttttcacacgcatcttcatctcctgctcttgctagatgtactaacaaagaatcagttttgtattccattcgcaaatttgcctccctctgttttctaaataatataacaatcctactataaaaaaagttagaattttcttttgtttttatttatatttttctaaatattcttccaaacataaattttcttctttcattattttagcgacagtcgttccaacataacggtaatgccatggttcattactaattcctgttatatccgttttatcttccgggtaacgttttacaaacccatatttatatgcattttcgtctaaccattgatatgctttttcagaagaacatttgtcggtatccgcattaatatcaacactcagtcctaattggtgttcgcttgtatcgggaattgcaacatatttctcggctcttttttttgcttctttcgcagaatatccttgtttttcatattcattgattttctcgtccataattttttgttgttctcctgttgttcgatatccttctctaacaaacagtgctagcccctcagctcttgcatcattaaacatttgttgtaactctggataaatccgtgaatctacttttttaccattcgacaattctgtcaattctacttgataattatttggaatataatgatttcgatcgaccaaaataagattccattcacccgaagtgtctgcaaaggacttttctgactgcaaaattttcggtaatgttaattctccaacctgcacatcgatttttattgttctccacattacaacggttattatgatagtcattaaaagaatgaatacacgtaaaatattctttcttctgcgattgctgtatcttcttttgttcattttctctcccacattttcattatcaaaatatttctacttttaatataattaacaaccaaaacaacaaaagagttagtatctaaacttatttatcaataaaaagtttattttttctcaattccagctcaatttcccctcaatgcctttttcctccgattttcgtatgcttatcccacagcagagcagtaccacaccggtacgacctgctgaatcaatcaatacgaaaaaaggaggggataaaccatgcagaacaatatccgcaacacaaacctgcgctttaattatgatgtttccccgttttcttctggacatggaaataaacgaaactgccaaaatgctttatattatcctgctcgaccgggcaaggctttcctagaaaaatgagggctggtcagatatcgatggtcatgtgttcatttactttacaattgaagcactggcagaagttctccacaaaagccagatgacgattaaaactgctctggcagtgctggaaaaacaggagcttatcttccgaaaacggcagggacccggacagcccaaccggatttatgtaaaactcccaaaagaaaccatccactatacagacagatttctttccctaagacagacagaaaactgtcctattgacagacaggattctttccctgatacagacagaaaactgtctggtaataaaaaagagataaaaaagaacaatttagaaaaaagagggagtaaggagccactctcaccctatggaaaatttcaaaatgtttttctgtcagaaaaagagcttgaagatatccggcagacaatccctgactggaaggattatattgaacgcttatccggttatatggcttctaccggaaagcaatatcagaaccatgcagctaccatcatcaactgggcaagacaggatcatcctgcttcccggcgaagaaattacgaaagtgaggaatacgaaacactatgacaagatttatagaaaaaccaaccgctataacaccaaacagagagcttcagcctgatgaatattttaacaaaacagaccacctgatctactgttccaaatgcaatacgccaagacaatgccggcatgaattacagggaaaggttcttattccttccatccgctgtaaatgccagcaggaaatctttgagcaggaagaagtccagagaaaacttcatgaaaaacaaatggaaatagagcatcttaaaaccagcagcttacaggacaaagtcctctatgactacacttttgccagagataacggcatcaatccggaaataaaactggcacacaattatgtaagcaactgggaagagatgaaagcaaacgcttccggacttctcatctggggtgatgtcggtactggaaaatctttttttgcaggctgcattgccaatgcccttctggaaaaaggcgttcctgtactgatgaccaacttttcccggattctgaatacccttaccggaatgcattttgaagacagaaaccagttcatcaactgtttaaaccgctacagtcttcggattattgatgatctcggaattgagcggaactctgactttgcactggaacaggtattcaatgtgatcgacagtcgttaccgcagtaaaaagcccctgatcataacgaccaatctcactttatcagaactgaataacgccgctgatatcgcacacaaacgaatttatgaccgtattctggagagatgtcagaatccagatacgtcctgattttcgggataagctgattgaacagctcaagggactttcggtaaatattatgactatcaccgtcgtgatattgcagccaatgaggtggattatctcaatgtggaggatcctgatgttttctcccatcgtgcatgggatcttgaatatcagaggaaacaggagatgcgacgaaatcagcctgttcgagctaagaaaaggtcacatgatatggaattataatttcctttaaaaagaggcgcatggatccatcaaatccatacgcctaatttgcacattgttattattctttccgaatcctttcaacaatgctttcccgactcatcttttcgaactgatactttggtaccacatacgcaatcccaaccaaaatcggaatcataaacacacatggcactatcgtaagatgcaaccggaagaaaaatgccgtaccgagtgtatttgctaaaatcttctctgccccaaacacaactaataatactgcaatcacaaatgcgcctcccaaatataggaatccctcagccactagcattttcgatatctgttttttcgtcattccaacaacttccaaaagtgccagttctttttttctgctaattacagaagttgctgttgtattaaagaaattcataataccaataaaggctaaaataacgacaagaaaactaccgatcatataatatttactgacataccgctgaaagctctctttcatgtccaatacagaaaaaacattcatcatatcattttctttcaaaatattttcatcaatgtattcttttatctgcttgtccttgcccttctttgcatcgatggcagcatacatggctgattcatttcctgtctgggtaatatactcatcttctggaactaataccgtaatatagataaggtctgcatacggataatccaatgcatatggcatcagtgcttctccaatgacttcgtaatctttttggtttccatttttgtactccatttgaaaaacatccccagtctgataataagaaaccggatgctctgcatatttatcaccataatctacaagcacataatttccgcttttaaatgtatcccaagagcatttttcccctctccattctaatttgtcaaacaccgactcgctgattccgagaaaatgaacacttactgtattggaagcctttgcatcttcccaaacctgttcttcataatcggtccagtttttttcatatttatctgcgaatgcttcccatgttttcagaagttccggctccatcttgtgggtttcttcagaataatacacatatcctgtcttagcactatcaggacattcgtccaaaatctctttgatttcaggtgtaataccgttgaaattcgtatttgacaaacttcccgtcatctgatccagttgaaaatcggaagctaaaaacacttttcggtaagaatcaaaatcatatccctgcaccaacatcacgatacagttgacaaccaccatagaaagagcgatagaaagcataacaatcaatccctttttccaatttcgtaacacattttgaactgccatcccccaccaggttacagaagtattcttttttattttcctatgtgactgctctccttctgccaaacgcagagcttccacaggcgaaactctttccaccattctacaagcctgcagactggagagatacaccgttaaaagcgttaaaagtatcgctgcaaggaaaatcaaaggattcgctgatactactgtctgagccgtttttcctgcctgtgcactaatttcaacatctgcagtcaaggacggagccatacaaagacctgcaagataaccacaaaacaatccgattggaatgccaatagctgataatctccacgcctgcatacgtacaattttcttcaactgctttcccgttgtccccacattcttcaacaatccgtaagcccggatatccgttttcacagaaatgttaaaaatattataaataatcaggtatccagctaatatgacaaatagaatcattataattaaagaagaaaatgaaaatgaatcctcttcaaagagattatatgccggattgacttccattcctgtcccagctctcgtaaatcccgctgctttggatatcttttccgttttcttttccagattccaaaggttcttgtaccagacagaatactctttccctccattgtagatgccattttctaattcttcctgcgtaacgggataacaattctcctttgcataggcttcggatacccagaccatctgacctaaaacagctttatccccctgccagaatccacatatctgaaacgtatctgtcttatattgtttcagcatgggatttacttcccaggtcagcgttacttcttcaccaatctttggtgtaacacccagagattccaatatcgtgctgctaagtgctacttcattttctttctccggcagtcttcctgtagttggcagacaattaaaactttctgccatattttcatctgcatatcggacctctacggaaaatccaaaccgttcgtccattccagctcccagaaaaataccggaaccatatcgttccacctcatcactttgttctattgttttttgcaatctctccgcatcttcttctgacaaattctgcgcaatagcatgggatgaatccataaattgcttaatttccgttgctcttttggaaagtatcatggatacgctccccacaaagaggcttgtaaataacagtgatgtcaacatgattgcaataacagcaataatatttcttgctcggttcattttcataaaacgtttcgtcaataatcgtaacgtttctttattctctacttttaccatataatcgccctcactataccaaaccactgtctgaaacaatttttccgtcttcaatctgtaaaatcctgtcagccatctgggcaatctcctcattgtgagtaatcattacaatcgtttgatgaaaacgcttactggtgacttttaaaagtcccaatacatcctgactcgttttggagtccagattgcctgtcggttcatctgccagcaaaatagcaggttttgccgctaatgctcttgcgattgccaccctttgctgctgaccccctgacagtgcacttggaagattttccagttttgtccgaatacccagtgtatctatgatttcatttacataacctttttcaatcttttttccatccagttttacaggaagaacaatattttcccatacattcagcatcggaaccagattatactgttgaaatacaaatccaatatttctacgcctaaaaatagtaagctcttcatctgacatatggcttaaattctgtccgtcaacaatgacctgaccagatgttggattatccaaaccaccaatgatatgaagcaatgtagactttccacttccagaggttccaacaatcgctacaaactcccctttttctacttccaggtttataccctcaagagccctgacttctgtttctccctgcccatatatttttcgtaaatttactgcttttaatatattcatgccatcctcccatcaaaaaagcctgtattgatctttacaatacagactttatcataacaatgtctccatctggtttctgaaatgtcacagttttaatactattccttctttgctatcggaagaaacacagaaaatgtagaaccctttcctctctttgatgtcacttttatataccccttttgtgcctgaatgatctctcttgcaaggaataagccaattcctactcctggctggtctgccactgacagactccgataaaaccttccaaatatctttggtatttcttctttttctattccaatgccatcatcaatgatatcgatctttacaaagaaagaatactgctcggcttttatctgaacatttcccccacatgctgtgtatttaatcgcattgtctacaatatttccgagtgcctccacggtccattttgaatcacatcgaacatgcaaatccgtgtcacataggctcagagtaatattcttctcccttacttttacgttaaactgctgctgtatagattcaagcatctgcttaatagtagtatcctccgaatgtactgcgataattccactctccatccgtgataatttgaccagtgattgtatcagaaaatccaatttctccgtctgctccaaaatggtagctatctcctcttgattttcattactcacttcagagagtatttctccatagactttcagatttgaaatgggagtcagtgtctgatgcgcaatatctgaaataagtttttgtatcacttctttctgttcctgttgatttttttttgccagaaagctactgtctatatattgtttcatgctgttttcaagagcagaatacttttcctctgatatttctgtccgttccagttctccatctattgcacaatccagcatttgctgcaaccggttcaaaagctttttttctttctgataaaaaaagctgtaccaaaaaactccgctcaggacaaatataactacaatcaacataattgtttctatcatccattcaccgcccaggtataaccaattccataaaccgtcttgatatattcaggcttctgcgtatcatcttctaatttgtctctgaggcgtttgattgcaacagtcaaggcatgggcatccacaaactctgtatctccctgccatacctcgtcaatcagatattcccgtttcaatacttttcctctgttttcacacagcactctaagaagcttttgttctgtcttactaagttcaataggttctccatctttgaaaaattccattttatcgaaatagaactcaaatccatcaagctccatagaatttttagctgctgcctctttatttctaagctgcacagacactcttgcacgcaaaaccatcaagctaaacggtttcgtaatataatcatttgccccagcttccaatcctgttacaatatctacttccatgttatttactgtaagcaggataattggcacctgactgtttttccttatttctcttacaaaatcaatcccattcccatccggcaagttcacatctaataaaaccaatgtgatatcttcctttttcaagacttctctagcctcctgcaaagtctggcactgataaaagaaataggaatcatccttcaatgcgagacgtattccatcatttaattttttgtcatcttcaacaatcagtaacttttcactcatattttctctgctttctttcaaattacgctaattgtatcattgccagttttataaatcaaatcattaaatcaaaatctccagcagaaattatcttataaacagcaaaaagctcccgaaggagctttccacactttaaatatcgaccaattcttttaacacaatctcttctgctacattttggatattacttactgcactgacaagatttggatagtaaattccatctgctcccagtgtgtaggttccacccatcttttcaaatgtgcttttcatgtgttatttctccttgaaatcagcgatgtccttagatcatcgcaaaatatttcagggcagccttgatagcatcttctttctctttcggacactgtggcatttttggattttctgtctttggcagattatagttctctcctacttcgattccacatttccttttgatttgagaaatatataaatttgaaaccttcaagccaaattccttcagcacataatctttgatttcctgataggtcgctttctttgcagacaaactatttttagttttgcagcaaatcaaaatcctcgtctgtacactttcggatgattcgttttgtcttttcgacaggtagcggaacattctcttcatcgaaatattcgatgttcactacctctacaactgcctcatggttatccttgcctgcgggtacaagcacgaaatcaccgatttcaatgctgtcatcttcggtcagataataataactcttatatccttcgtcaaagataacactgcaaaagatgtattccgacttgcggcgttttgctttgccgtagaccgatgggtcaaggatttctcccaaaccgtagaaacgaatgaagtcaaatactgtttctgcaaaatctacgaaatcctctggcaacccatttttatcgtagcttcctgtaatggttcgtctcggatttttcttatactcaattgttatggtgtaatcctttgtttcgtttggtgtgtctatcacatcatcgggatttccttcaatgtgggcaaacaagtcctccgcatcgaaattttcaagcaagctctcaattccgcctttgatttcatacttacgagaaaccttacatccagtgccaatattctgaatatgctccaatgtttccgtggctctatcgatagtcagctgctcggtataatcccaggttacaaattcccagtctgcgttttctggtttctgaccaggttttatttttgtgaccctgtggtaatccagagtgattttatttatcacgtccggtttgcagtttccatcaaaaacatacaaatcatcaataccaaccgtatcacggacaaggtctgataaatctgtaccttcataatcgaagtcagcacacaaagagcccctgaatttatatgtgacgccttcggtattggtcaattccataatccaatcaccaatatccgtagcaaaaatttctgtatactcattaccgaagtaaactgcgattgcactaaacaacttgtctgccgctgacttatcaattttgaagttcttacttctggctttctcgtatcgttctccgcaacgaccaaagttgtatccggaaaaccaaacacgcccttcattattgatggttagatgctgttctacctcttcatcggattccggcataggtccatagcaaatattatttgatacgatacgtatcttctttagtgtgccttggaatataaaaggattctccccggacagcaatgccagtctgcttaatgccagaataaaccacgcacgatttttcggctccaagatttctgcacctgtatatgcccaatgattgaaatagcgccattgggaatagattgcagaaccaagcaagggaatatcggtcacatcagcgataatcctatccaaagcctcatggttgtttgctacattgccgtatttctctgaaaaggcatgaccaaagtccatcttgaaaccaagagtatcacaatcgtcagccatataatggtcaacgagttctatgtagttgatgttctggtctctgaacttatcgcaccatttcacagcgaaatcgtgtatctgtttcatatcagccactgtggtatacctcccattctttatttttgtggtatcgtatttacttatgtgttttagtcaacagaaccacgcactccacatgcggtgaaagttacttcttatactaaatagcgaaaccatcaccttttgcgaaaaggtttataccccacttagggggatagcgtttaccccacattccctattcttcaaacagcatatctttcattttttcatttgcttcctgatacaatgattccataaaagatgtcattttagtctctgaatatttttgtcttaaataattactgaatggttttaatttttcattttcataatactctttcaacaaaccaaaaatatcttgttgctgctcgactaaatacattaacatttcatattcttcaatattaaaattgaagtagtatttagttttttcacatttcttctctgcttctacatttttatgtatttcattataataatcgggaaccgcattaatattatccattgttacagaaattatatatgcatcttctactcctgtaaactctggcttaacttcaataacagtagccaaacaggtatctgcctgaataataggatttgcgaacattctattattatttttttcaacactttcatttttggtcatacaatctaataaaacagaaaatcctttcgcctctattactaataaattattatctttccgtatataggcatctgaagattttttattatttttttcataagcaaattcctctatatagaaataacttccttttgtagcctcttgcgttaaattttgaatgtacttttcaaaaagtctcccaaaaaatgccattgctctactatcatttttcggataacaatctctaatcatccagaaaatcttttcaaaaagtgcatttctcaatgtgatgtcacataccgatatatagtttcctttgccatctttgataaaaggaaattcgaagaacttactaaaatcccattcctgattctcactttccgatgcccatgttgcatagtcttttacctgttgtgataatactccaataactttgttgatcagttctttttctttcatttttccataaactttctcgacatttcgccacattgtatcatatatcaaaccatttacatcactataataaatgctcaattcccaaaaaagcaaaaaactatattgtgtaggtgtaaattgatacttttccgtaaaagctgaataataatccctatactctttctgaacatctacatcaaaattgtttatgtccctactaattttttccatcatataatacattcttagaaattcatgtgcaacatttctctgatagttcagatgatacgttgaataaagaaaatggcttttatcaaattcttctgaatgcttctgattaagttgttctgccactactaattgcaattgaataatctttttataatcttcttgtactatttcatattgtgtatcacatatagtttcataatttccaaattgaacaaattttttgagtaatataagcaacatttgaaccgaaataatatgtacatttctttttaataatggatttgcaaataattcttctggagatttcagaacaataccgcacatctctttctttaatacagtttcaaatggaattctaaactctccccaaaaaattcgtaccggatcaagcattgcatctcttactctaattaattcacaaataatagaaatcgccttatgcatattcatgttattgatttcttcttgcaaattcggcatttcatcagaaaaaacgtctgtatatcctaataacaactgtgcatcctctgcatcaactgaatacattttattatcctccttcaaccccaatttatagtatttttaatcattctgctctcgatatgttctgttttgttatcctcgctcgaaatctattttatcattgatgctattgtaccacagacatctcatttttactatttgaaaaagagcaagaaaaaagccgatcaggaatcgcaactcccaatcggcatcttttcttactcctcttcatttttacattcaatctccgttccatccaggaacactaccaacaatgttccgtcctcaaagaccttgatgtggtccagcgttttcagcatgaagtccgtgtccatctccgtcaaaggctctgccccatcggtgtattctatgaacttctctgcccgataaccttccaagaggttctcgctctgcagctgttccgtccactgctccatgaaatcctctcgattctccaccaacgcattccaagccatcagatatgcctttatcagcgtttcttcctccatgtgacggttggcacatcccatgactcctttgaccttgtagcgttcactgcactgccataccttacggtcaacacccatgctgctccgccagccttttcgtgcaaataccttattgcagtctccgcaaataatcttggatgcaaatggattgctttccggccggtggaaataggagtttgtcccatgctcctccaggtactttttcctgcgtttgatttcaagctgtacacattcccaaatccgctttgatatgatggcatcatggccatcctccacataaaacatctggatttcccctttgttctgcgtccgcttcttggtaaggaagtccaccgtatagcttttctgcaacaatgcatcacctttgtatttttcattctccaacatactcattaaggttgtagcctgccacttcgtaccgccatcccaattccgaactccctctttttcaaaaattctcttgatgtaatccgttgtttttccatccaaaaattcctgatacaatcgcactacaatcggttcctgcattctgttgattaccagcttgccattctcgtccgtgtcataaccaagaaaacgctttgtactcattttgtgttttcctgtttcaaaccttctgcggattccccatgtgcaattctctgaaatggaccggctctcatcctgcgccagtgaggaaagaatggtaagcagcacttcgccctttgcatcgagggtattgatattttccttttcaaaaataatccctatccccaagtccttcaactctcgcacataattcaagcagtccagcgtatttcttgcgaatcgggaaatggacttggtaatgatcatgtcaatttttcctgccctgcaatcggcaatcatacgattgaattcatctctctttttggtgttggttcctgaaataccttcatccgcataagttcctgcatattcatagagaggattttcgctgatataatttgtgtaataattgacctgattctcataacttaataactgttcttcttggtcggttgatactctgcagtacgctgccatcctcaacttctgcactgcctgtgctgttcctgattccgcagtcgaaatctactttgctggtataactgtaatacttcttgccatttcgagtcacctcctcaactactttctgttccgcaatatttaatccctgcagttctgcatcatcaattcgtatccctttacacgccttgactcccttttcaatgtaggtgctgcagagccattggattttcttcttgtaaacctgtctacgccggagcgtttttccgcagtaagggcaaatcagcattccgcttaagggatagcggttctggaacttcattgtgctgtcctgtccgatattcctgtcacgctttctctgttccctgacttcctgcaccttttcccatacctcaggcgttacgattggctcgtggttctccgaaatgtaataactctgcacttccccgttgtttttccttgtatggtttcttttgttttcaggggtgtaatacttctgcagatgaaaatcccctttgtacttttcattgcaaagcatcccattgatggtcccgctctcccatgttgttcccgtcaccgttttcacgcccaagtaatcaagcagctccccaatccttgacgagccgacattcattagataaaggtcaaaagtcagactgacaatttccgcttcctttcggttcacaatcaaatctccatattcgtttttgtcataaccgaggaaacgagaggtggtaatcatcacttcccctctctcaaacttctggtagtgtcaaatttactacctattttttctttaaaaacctttattttcgggagtttcaaataaaaagagcattgacctcccttttttggtataatgtcctcgaccaaaatttcactaaccaaaggagacaatgctcactagaaccggaagcacctgcccctcggcaaatctccgttcaaaagaaccattggaaaaatgatcctctctcagcagcattgtcaataatgctgtgcaaagttcataatctgccctcggaatacgttccaatttttcatcacagtcaatcggctccgtaatcatataatccccataattatttttcagatcccccattgtctttaacagatctgcatacagattctcttgcggattctttaattccaatatttcctgaatttttcgtattttctctgcctttgtcaatgctatacaccaccttaaaccttcgtagtttctcgaatatatgttctatattatcacatcgacgcagattattccatccttcagtctatatattcagcaaaatttttctctgcataactcacggcattttttatagcggcttcctttttcagagtttccctatacttttgcatctgttccgcataatcgtcagtttgtgacacgataatgttattaacagcagaaagaaccattccaaatttctttttatcgccatttgcaaattctatctctatggaacttccatgattatccgtaattgttcccagaccatatttcttatgctgaatacctgcgccaattttaaaaaccatattcagatattctaatgcttcctgcaatttcttcaattcgtcttgcgctgctttcagttcttctgcaaagcgaactgctttctctttcttttcctgtatcagctgtttttcttttgtctttggacgtttaaaagttataccggaaaaaaatccgtatgtagagcagcaataaattaaatcaaaagccagtatatgtttttctttatcctgcgcaaaagtctgaggatcaataccccatccattttcaaaccggctggtatccgtcttcatcatctcaggactatttttaattgcagatactatctgatcacacatgcggtaatagacatctaattttacagaatctccagatccccaatcgtcataaaactcaatacagtcagcaaatataagtgcatgactcgatttaaaaatatagttatgatctgaatcatacagaaacagatacgttgttactgaatgcatatcatccttatacagataacttcccggaaaatatttatcccgaagctcatggcttttcttcaaaaatgccgcaaccgcattctgccttttttccatagtcccatcagaattttcaaacagacttttaaacatatttctcactgtttccggctcatgctctgaaaaacgtatcaatccctgaaacggctgagtataactatccacaagattgcttgtaagtttcttgactttaagcaagtttgctgcaaattctgaattttcacttttcaacgcatcatccattaaaggtcgaaatctcttaacgatctgccatttataatattccatatgctcaggattattcagtttttcaaaatcatctatataatgcttaaaaatttgctccatatgaagctcattcatagtgttctcctccccatcttctaaatatcaccagttgttcagtaatagaatttgtgatgattcacttttttatcttttataaataactatatcataaaccacacaccttggaaatacagacaaaaaacaggcttcacaccacgaaccaactcgcaatgcaactcctcatcactcactattatattcttgtcacaaaatccagcgagatccacccattccgctctttctcatatgctttcagcagccccccactttgatgctccaacaccatcagcctcagcaacaatagtaaaacagccagcacccgtatattttccggtcttcctctgatccgttcccggcttcttccggatattcaaattcgaaatctccacacgaaccagatacggacgaaacacctcttccggcttcttatccacggaactgtacactgcctttccattctcatcaaacaccgaaaatcccagatgctcgtctgcacatttctttgcgttatccaacaccttaaatgcccccacctgactctccgcatcctgccagcttttccgcacatggtaccagacctctttttcagtcttcacacagtcaaatcttgtcagaccatacttctcaataataacgcagatcttctgcacatataaactgtccgttgcataaccgccgttcttaataatctgaacatccttccgataatctctttctccaaccagcccctcatatctctttttcttcctgttcattgcgcccaggagataagcagaatgatccgcaatcggctactccacacaggcatacttccgaaaatccgcagttaccgtataaagctttccagtcccatcatcctcctgtgtcttcttccgatacttacgggttccatcctaggcacttccgccccagctattcccagacagcacacacttcattccaaagcagttgtttgccttctgcgccagttccgtcctgccataacccgattccagaataaactgcgctgcagacacagatgccagaatcccgctggtcttcatatcctctgcacacagcactccaatccgctccgctgacttcccatcggaaagccctggaaacacagaagcctgcgtcccttcagctttcccagacatggcagccttcaccgctttccggaatccatccatcgtataagccagtcccagacctttccacagatgctctggatccccatggttcgtagtaatcccccttgcaggtccctctctatgtgaaattactacaccatccgccagaggatccagaccaaacttcttacacagcatggcaaacagctccaccgctgcttcataagtccgtactgcagatgcccttgccgtcaccagatccactggtgtaccgaatgcaggcaggctcacacatctccacaccaatatgcgtattatttccgcatcccttacttccggatccacagtgccatcccctgtgatcccagggaagtgtctaatacacagttccgtcatttccatcaataaatccatccacacaggcacttccaaaagaagccctgttccatgaatcaagaaatacctgcgcattcggctgggaatacccaaccgaatgaagcatcagtccttttaccgcaatctttctccctattatccgaatgaatgtgttgcatattcttttttctttgatccggtgtcaaattatccatatcaattaccccaaaaagactacatcattgtgatattcaagaaatgatttaccgggcaaaaatttatctggaagattgatttgtttaccttcatacccatagaaccaatctcttgtttgctgatccatttcagcatttttcatttctttagaaactatcagccttaatttactgtctaacgttattaaacctctatcaaaggccttatcatgtaatgaatttaaacacaatccattacatggatttgttctttcagttttttcatcacaaacattccaaggtttaatatgactcgcaattaacaaagatgattttgacattcctgttatacagcatttatttccgtatgagcttaaaacagccattctgaaaaaatactgtccaacacgatttttcattactcgctctttatattctcccggtggaatatcatcaatatctcccacatcaataatttccctaacttctacattttgcattcttgctcgaatttcctgagcctgatatgatagttctgtccaatcattgcaaaattcgctaaatatttctccatccagtttactgccatgtgccattgctgtaacatttcttttttttaattccggatcataatgcgctaaattatgcatctttaatcctacagatccaggcgttctacctaaaagttctgcaagcttttttatttctggatttgactggctaattttactaaatggtgttcgacaatataattcatatgctaaaattgtttcttcccggctccattttactccattccgatttgccatattatcttccttatcttaacgtgcttttccaattttgatttatttcttacactcactatacactatatcacatttttacagccagttattttttaatcgcataagttcttacagttcatactttcgctgctttttggcagcattttgttaattttttcattgacattaggcagcgtgcgtgatatactttcacaagaggtgagagtatgcccaatttaggccaatttataaaatccaaaagagaatcttccggattatctttaaaaaaattaagttccgcaactggaatcagcgacactgaaatattaaaaattgaaaacggtacccgtaagaaaccaagctgggaacatctttgtaaaattgcaaaggcattaaattttcacccatttgaggttttgcttagtgctgggtacatatcagaaaatgatattcatccaccactattgatcagcggactggaagatctgaatgagcaacaactcaatacagttcaactgttcgttaactttatcaaaacacaggaaaagacctgtctgaacgattaaggaggctacttatgcaatacagattaggagaattattttgtggtccaggcggaattgcatggggagctacccacgctgatataggcaattctgattattcaattgtacatcaatgggccaatgattatgatgcaaatacttgcgaaacataccggcacaatatctgccctgatgcgccacaaacggtttaccatgaagatatccgtaaattcgatatgagcaagctggcaccaattgacgctctggccttcggcttcccctgtaatgattacagtgttgtaggagaacagaaaggaatggacggtgtatatggaccattatattcttacggagtaaaagctctgaaaagatttaaaccacaatggtttcttgcagaaaacgtcggcggtctgcgtaatgctaacgacggtacggccttcaccaaaatcttaacagaactccgtgatgccggatacataattaccccgcatctttataaatttgaagaatatggtattcctcaggcacgccatagaatcattattgtcggcatccgcaatgacattaatgtaacctatcacgttccttctcctgaaccatatagcgagatagacaacacctgcagaaatgctattgaaaaccccccaatccctgcagatgcaccaaacaatgaagctacgcgacagtcagcgaccgtagttgaacgtctcagacatattcgtcctggtgaaaatgcatttacagcggatcttccgcctgaattgcagcttaacattaaaggtgcccggatcagccagatttacaaaagactggatcctgaaaagccatcttatacagtaaccggaagcggcggcggcggaacccacatttaccactgggaagaaccaagagcattaaccaaccgcgaacgtgccagactccagacattcccagatacttatgaatttcagggaaccaaggaaagtgtacgtaaacagatcggaatggcagttccttgtcgtggagctcagataatctttgaagcgattcttaaaagtttcgcaggtattgaatacccatctgtcgaagctaatatcaatgaataacaaaaagtcggaagtttagcagcttccggctttttattattcatcacttttcttcaacagaaaagtccatatagtactgttcttcatctatcttgtaaaaagtcacatctgttcttccatatgcaagaagatcatcttttttgacatacgctccattacataatccaagccggtttctaaaatattctcccagcaacgcattactggcaggagtggtaattgctttatcattctgctgttctactctcagctgtaacgtgtgatgatcatctgtaactactaaaaaatgctgtttatccaacgggaaaaatccagatttcgcaatatgcgatggcaacggaatataagcctcatttctgtttcttttattcctctgcccccagtttaatccagatctagttccagtttctccgcctcgtgccaagagtgacaaatgcacacaattctcagcatctgtttccatttgttcccttgttgtatcttctgctgaccgcaaaacaacatattcatccacttctgcatatgtgcaatacaccgtccttttctcggcatctgtatatattccatacgcttgaacagcatccgtctcatttacattctctttatcatcatgcaaaagatattgctgcgtaaaaggttctgaaatcttatacgcccttaccggcgtgtctctattcaaccaaatataatagctgttattttcaaatgctggcggatgtgtcaaataactacatgaaaaattcccccatgtgtctgaatatctggttccatgcagttccttaaaactttcatgagatcctttatctattcccttattcaaagtatcaccgataatcaatttgactgtcacatcggaaattccaagttcctcatagctttttagcagccacgaagccatactcggtgtagcttctgctgttaaaatacacagcctgtctgcgccctcttttattggatcaaacagaatttttcctgcaattccatccggatattttaaatcaccgctcatcaagcatcctcctcaatgacatcataatacattgtattactcggcaattttatattcggaacccagagtttctttccgccccatcctttcgttccagttacctgatacatcgtcagaaccactttatctgtaaaagttccacccagctgccagtcattaggtgacagcaatgcacctgtaccctgagcaacatttctttcccggcgtataatcaaaatcccctgtcctgtcggatgctctgacaaaatagtatcgataacagagcagaatgccaggagtttaaaatcaggactcggaataatatgtgccaatatttctttcaccagacgaagactcacctgataatacggctctgtttcagaaaacgcctccagaagttttgatatatcttcaatagaatcattatcaggattaaacggatagtaatttgttcctcctgaaataatttccacgtggtcattatccaatacatttttacgtgttggattaagcccctctggataatatatcttcacatcctcaatgcccttttcaacctgtgcaattatagaattattggtagcatttatatctgcaaacaatttatacaggttttcatcaatgtaaaccttcatcatgcccggatcacgatcatatccaaacattctgctgtgctgccacattgtatctgcctgcggttttttactcgttctcgtatagtaaatagtctgtaatcccggaaatgttacgccacggcccaatgtgtttccgccaacaacgaaattgcagccagcttcataatctgaactctccacatcattctttccattcataacaagaactctgaactgatttccagttaatatttctttaactttagcatacaagtcttccaaagaacacttttgagatcttgacggattcatatctgcgtactgtctgcttaattcattctttaattctgcatcaagattttcaatacaccattttagttccttctgtatatctccttcaatcttcttatgtacagctacccttacgctcggatgaaacaagcagttagatactttaccgcctgacaaaagaatctgagcagacaccaacagatgtcttacaaccacttctctcataggcattttaagcttttccaaaaatgatacacagtccggctttccacttgaagggaagaaaaaatcacctccaagataagcatctcccggctgaaaataatatgtaaaatatggatgccatccagatgcaagcgactgtaaaaagattgcctgcggcgttcctgtcacctgcagatataaactgcttgatgcaccattttttatgctgtccagatatttattaattgaagactgccggtttctgttgaccaacgtatttaatgaagccgcatcagcctcatcatcaatgatgaacagcggatttcctttcataaaacctgttgaattaagaatattcgcccacaatttcagcatccgcacattcttttttaatacaataattacaggatccatcagactgttttcattgaaaagtgccgcatcattttctccacaaatacagaatccatcaagatctgtttttactcgatccagagtttgctgctgaagaacaacattgtctgtagtcagtaaaacaaataccggaaatcctaaatctgccgccttacatataattccaaacatctgtcctgttttaccggattgaacatttcccaacaacagaccaatttcatgactggaaaaagaaaatgtttttatatgcttatttccaacatcatttgctgttttttcaatagattctgcaagttttgtatttcctctatcagttatttttttaaggtaggttttcaaatactgcatatacttttctcctattcatcttcggatcctgctgtaaatgaaagcatccagacatccagcggttttccatcttcatccaatgcagtctgacctgtcttcttgaattccagcctgtcgcatccatattcctgaagcatttcttctgtaatcattcccaggcgatccgtatcaactgccgtattatttactggctttactatacctgccgctgccagccttcctttcagccatcttcccattatcaattcatcgccaactgcactaaactgtttattattatcacttgttgtatgtgctttgaaccaatatccatcatctgtcactacaaaaaatggtttattcttctctggataaccttccatacggtacacatctgcgccaactgtcagctgagtttcataccagtctcttgcctttctcttacttcgcggtgctgcataacagacattaatatttgactttgtataatgctttccatcatccaaatgacgctcatctttcttaggaactttcagtttcagaaagaatgaaacatacgctttacatctttcataaaactcaacatttgattttggtacagatgtaaccagttctattccatttaatgcagtattaacttctctcacaagcggcatattctttacaagcgcaatattctctgagcagttttgcattttcaacttctcaatatgttctgcaatctccgctacttcctgttcagttgttgtaatagcagacatctcgtactgccttctattgcttgcttccaatttgataactccaagatttgcagatccgataattgccgaaaatggttttccgtctttataaaagcaaaacagttttccatgatacttgaatgcctttataactcgaatctcaccagtatctgatttctgccacttttcattgatttttattgctgtatgatacgctccttctggcatgccttcaataaaatacatccctatatttaagcaaactttagagataccacattcatccacaagcctgtctaattcggcaagtgatgcattagaagtatatccaactgcgatttcgactctgtcagctattttcatctgctcattaaagcagtccattattgtttcctgatcatcctctgttcctaatggcagaatatttgaatataataatttcatcctgcaccccctataaactcttaatgtattattcaattttactgcaaaacaactgataatgctaggacataaatgtattttcaatttgtatagtaaattattttcaaagatacaccaaacataaaaaagacgctaccatttctgataacgcctttccaaactatatcaatttgtaatctttcttccacccaactgccatttatcatgtttcttaatgctccgcacagcctgccgcagtgtattactgcggccatgctgatgatacggatgggacaccttatgcttatgaaatatgatacaggatcccatcaatggatattctggattatgtatataccacatatgccttgtattccgggacatgatggttacatcccggtcatccatataaataatctcaaaataccccagatctagacattcaagatcttctctgctaaacacctgctgcctcctttccaaaatacccttccaatgccttctccataatctcctgcactgctccggcatccatctgtgcaaaatacttctcatacaattccaccggcagtttcacagacacactctgcggcttcttcttttctttatacgccagaacaccctcaaccgcctctttcgtaatctcctttcccatcttccgcagttccactgcctgcttcggtttcagtttctttccctcagcctctgccacctgctggatcatcttttgcatcttcacattcagataagacaaatccacagcggctaccattgccagtgttcccttatccacagcatccttaaactccggaatcagccggtctagccgcatgtatctggcaatattccttccagtcattccatattcctcaccaagtccatcacggcttttctgtgacttgtggacatcgtgtccacaggtttcttccagagcctcgatttcctgccggatatcatttcgtttcccctgactgcttatcttctcataacgtgccaccagcactgctgccttctctgatggaagcagttccgcaaaagatctctgcaacaggtttgtctcgattacatatacgtaggcatcctcatcagacagatccgtcttcactatcgccggcacttccgacaatcctgctatcttcgccgcattggttctgttatgccctgcaagcatctcatagccccttgcagccttcctcacgatcaccggattcagcactccatgctccctgatgctctataccatgtcttccaggcgttctccctcatacagccggaatggatgatcatgaaacggatgtatttcctcaacaggaatagaaacaatcccgttcacagccactggcgtatccttcaccggatcctcagcaagaagagccagtgcgtcctgaaatacttttctttttggtgcattagctttcatccccagacacctcctctgccagattccgatatgctttacaagccttattctccggtgcatactccagaagcggctcactgtaataaattgattctcccacctttactgtgtttggtatgatgctcttaaaaatccggatctgtccatcaaaagtatccgtcagctgttctgtgattaccttacagagatttgttctggcatcacacatagtcagcaggatcccagcaatctgcaggcggtcattcagtctgcttctgactttcttcactgtccggcgtgataatcagctgaccattttcacatttcacctgtacataatccccaagatgaaatcccagttcttccagccattttccttttaatgtaatcgccggaactgtctcatatttataaccactctgtccacaaaccttcatatttcttacgtttttctttgccatagaattgactcctttcagatttgactaatagatttttagataaaaagaaaaagccgctgacacgttatcttctaacgcatcaacagcttctatcctgctttaattcagtgtattattcggttttgtaaaggtttatttgctttcagcattctccctgatacggtaataatcatccatatcaatgcctatttttaccttggcatctggttttcgtttgcccaaaagacacacagtctccacatgtgttgtcactaacataggaacacacatcctttacctcgtctacgatatgggaacacatttctttcgctttttctactgcttttgatttcttcccaaatcgttcttttgcgtttccaatttcatttttgaatcctgttttatatatgaaaatgattttatagggatctttctctccattttcatcgtaaccaccgacaataactttttcgatgatactttcaaatattcctctgtcaaattcttctaagatctgattttttgacaatgtttttctaaaatctgccagtcttctttgcaagctgccttcattgtcatattgttgttccaacatacttaactgtgcttttgcttcagacaatttcttttcataccccacatctgtttcctcataaatgtctttagctacaactccctctaaatagttttccagcaacttttttctcttatattgaatattataaacacttctattgagtttttcaattttatcttctatcgagtcctctgataaagttttctcgactctcttaataaattcttccaacacatctttatgatctgtacataacatacggtaagattcaataaaagcatcttctataacctgctctggaattcctttactatctggacaaaaccttttaccatgttttgttgattctacacattgccaaatagtttttgtatatttcgaactgctatgccaccttctccttgataaattcgcaccgcaaaatccacattcaagcatacaactaaaagcatattgtctactgaatttttctcgttttccaggtgctactccctttttgcgtcctccattacggcgttcccgtatctcctgagctcttgcaaatttttcttctgatacaatcggttcatgatgatttttgatgtaaaaccgatcttcttctccaagattttccagccttctttttgatatcggatctactgtaaaggtttttcctaataaaatatcacctttgtatttttcattattaataattcccattacactggaagaagtccatggattccctttaatagttgaaattccctgttcattcagttctcttgcaatcatcgtacttccagcacctgcaacatatctatcaaatatgtatcggaccgtttccgcaccttcttcgttaatagacagcgactttgttactacatcgtaatcatatccaaggcagccctgaaaaccaacaagttctccacgtttcatcttcattttcaaacctttttttacatatgcagatgtattttccacttcctgctgtgcaacagaacttaaaatagtcagtaaaaattctccatcttttaaggtattaattttttcgacttcaaaatataccgctatattcctctctcttaacattcttacatattttaatgtatctaatgtatttcgtgcaaatctaggaatgctttttgcaatcactagatcaatattgcctgaaaggcattcctgaatcagtaattggaattcttctcttttatctgttttcgtgcctgtaattgctttatcagcaaaaactcctgcaaaaacccattgcttattactctttatcaagtccgtgtaatatctgaccattgaattataacttttaatctgatcttcatcatcagtactaacacgacaatatgcggcaactcttaatctatcaatctttcttcccgtagaagtatcctcaccagcacccttcgccttaatgatttcaacttccatttcaccgctcctttctttttgtgttcctaccgtagtgttgatataatcttacaacgcaacactccgatagtcaagcggtaatattagaaataacaccataatctttttttaactttttctctaccagctgatactctgcttcacttataagttttaacgagcgtaattgtttcaacattgacagctgcatacaatatggcaaatagcaccattaatccaagaagtacccatggcaatgcagccgaaataaaatcaatgaacggattgccgtcaaatacattaccaagaataatcataacaacaccgattacgatagatatccatacaaatttgataacgttattttcggctttggctactttcatgtctctttcaattttattaagcaatgtcgcatctcctttcaataattcatccaggcttaaatcatataattcactcattcttataatgcttacaatatcaggtagtgattttccattttcccagttagaaatagtctgcctggaaacattgaggtcttcagcaacctgttcctgtgtaagtttctttatagtacgagcatttttaattttatcagctatcataattctgtatacctcctttcttccatgagattacagcaaacgtagtagtaacgtctatcaaaaggcttttacatattagataaaatcatgtaaaatttcttttacatagcttaattgcagtctatttagcttgtttcttgactactcatgaaaaatatttttactttcgccccacctgtattttcagaatttgaaagtttaatccctccgccatatttttcagccacagtttttgcaaaaaatagcccaatcccataatgggcttctccatttctacttgtgtcatccataaaaaactgctctgtgccatgcaataatgcttcttttgtaaatcctgatccactatcctccacaatgaatgtcagccgaccatcatgctcctttgcaccaatataaatgattccattttcttttgtatgctccactgcattctgaatcacattcattactgcccgaaacatttgatcatagacaatcattacctttttatcactttgctttgccttccaatctattttctggtgatagatttctgccagcccaagtgcctgctcctttatatctgtaaaaaaatcttctaacatcaccgttgtataggtaacatcactgcaattccatgattttgtgacatctatcaactgctggacataactttgtatctgtgttgtaccgtttaaaacataggtaatattatttttctgttccgtggtcagttcagtctctgaaagtagttctgcatttccccttacaatcgtaagaggtgttttaatatcatgcgccaaaacagacatctgctggttcttttcctgctctgttttccattgcttttctaaggattcccgcaatgcatctcgcatatcatcgattgccgataaacaatcatcaaactctttgataccggaaccagatgtcccatactccaggttctgattctttatttgatcgatggcatctaacacaggctgcatctgctttttgattctttttccaaaacatatggacggaatgatgataatcgctatcgctccaatcacagccataatactcatcacattctgaggtcctataaaatgctccctcaaaaaagccgaatgatactgaggtgtcaggcgatattgcaaaacaacatattcattttcccttgaaattactttataaaaatatttcccggatgcggttccatactttgcaacattccatgctatctgttcgtattgttctggaagatttccacctatttcctctcccttctctgaaaaaatgacataattacaaagtgcaggaatcatctcagcagtcactttatctgcatgcaaaatcgtatcatatgcttcattaatcttttgctctgcataattcgccggataaatgcagcccacactgatcaaaaggtaaagtagcagataagcaacaatcaccaaaccgactaatgatccaagcatgacaagtacatatctcataaaaatcttgctgagtgcattgcttctctttactcttcccatttatatccaatcccccagactgtttttatcggtgtataatcataatccgcaaattttgctcttatatttttgatatgcgtgattatagtactgtcattactctcattgtcaaagccaaagaccgcttccaatatctgttccttcgagaaaacctgtcctctgtttttagccagaaattcacagatttcgtactccgctttcgtaagaggaagttccttatcatcaaccaatagtttcttttgagatatttgaatacagaccctccccaaaaccatccggacagaatgttccctgtgctctcttctaagatgtgcattgatccttgcccgaagttccatcactccaaatggctttgaaatataatcatctgctcctaaagaaagtccgtttaccagactgttttcctccgtttttgccgtaagaaacaaaatcggacaatccacaagtatcctaattcttttgcataattcgaagccatcaattccaggcatcataatgtccagtaaaatcaggtcataacgatgtaattcttccatattaatttttagtggattacttactttggtaaccagatgtccatccttattcaaaatgctttctatcatttccaaaattgccggttcatcatcaactgccagtatttttgccatagtttccctcgattctattccgatattctgtttccttcccagtggtttacccaccaaaaatagtataccatactaatccctgtaaatattaagcaacctggtatgaatgacaaccattcacctacactagtttctcccaatacagattgcagataagtatatggtactctacccgtccagcagacaaatacatatttccacacataatctccaagtccggtaagcatcaatgcactaattagtcctgatataatccctgctccaatggataccccttttccaaactgaaaagccagaatcagctgccacagataaagtggaacactgcttccccacagcagcaatgctgcaaatatacatcctttcatgatttcgatatcgcttgatgcgattcttccaaatccaattccgaatatgattgctgtcaataggatagagcacagacacaaaaccagtagcatcaacagtttcgataaaaatgctgcaggtttatccggtaaagacaacagattttgaaaatcacctgtattttgttcctgttccatcacacttgctgtaaaaattccaataagtaccggaagtcctgctcctattgcctgataaaatgcaatcactttcatattttcattccatggtgaaaaaaagtaatatattaaaaatataacgctggttataatcggaatcagtaagtgtgccagaatcacagatgttcctttcatctttcgcaagtctgcattaagagatcttccaatcatcttatttcacctctcttctctcaaaccatttcaaaaacagaaccgttacaaaaacaaaccagatgattgagagacacattcccggaacaatgactcccgtatccaaaagaggattccctgcttctgcggcaagtccatttggtaaaacatgaagcaacgggcacatcattcgcatagggattgcagaaacaagtacataccagattctggtttgtgatattatcacaccgctgacggtaataaacaggcagacgaacaggtttacaatcattccaaatcgttcacttaaaaataaagctaccggaatctcccataactcagaaaccgtcagaaacaatactgcaatcaacgctcctccaactggaacatgtgtcgttagaagaaagcctccaagcgttgctcctgcaaacacaatcacattagaaaacaaaatcatgtacccaatataaataattttccccagcaacaattttcttctgtctgtgggaatagtcattaaatgatagtattttatctttttctcctgcgccacagaaagataacaaaatagagcaatcatccccggcagcaaaagtgtataccaccagttccaaacactttctgcataagcatttgtcatcccaagagtaaatataaatgccataacaaatgtaagaagaggaaatccccagataaacttttttcgcatggttcttttggctttttgatgttctgcttttataatattaaccatggatttcacctgctttctggttttttcttaccacattcataaacaaatcttcaagattatctccctgctttaatgctccttcgtatcctaagattccacctgaaataatcccgactttatctgcaagtaactgtacctctgagagaatatgactggagagaattacagtgattccctgttccggaaaagaccggatcagctctcgtaattcctcgatgcctattggatctaatccattcgtaggttcatccaatatcaaaagttccggttctccaagcaatgccattgcaatgcctagtctttgcttcatccccaaagaaaactgtcctgctttcttctttccggtgtttgtaagtgatacaatctgcaagacctcatcaattctgttttcatctgtaccaagcaataattgtcttaccttcaaattctctctggcggaaagattttcataaataggcggattttcaattaacgctcctatttttgataaatctttcctatccaaaagttttccatcaaagtaaatctttcctgcagttggtttcatcataccagtcaacattttcaatgtggtagattttcccgcaccattcggtccaagcagtccataaatctgttccttttctatattaaatgaaacattatttaccgctttctgctttctaaaatatttacacaaattttgtgtctgcaacatcatttccatctttactatccttccttccatatttcatttcttactgaaatataacctaacagaaaaaaataaagatttgatgaagattgctaaataattcgtctactctatttttattctcgtatggaataaaccatcaattgaatatcattatcagaactcggctttccactgaaatcagcaaagctgttacaaatacgaagtcctaatttaccgaatatctccgtgatttcatccaaactatataaccttataggatttccttctttcatttcaggcttataaagtgcttctccatacatatagtctacctgcccatatatcagcatttttctatccttctcccattcaaaagcagataatgtaagtcccttttctcctgcatcccataacttgcaagggaaatgtgtttgggcatagcttccattcatgatatccataaagtgctttccaccattttttaatgctttcgcaatgacagaaaaaatcttatgattttccccatcgtcttcaagatatcctattgctccatccgccatattcagcacaacatcaaattccttatcaaatgtgatcgtgcgaatgtcctgacaaatgaactttgcattcaaattttctttttttgcctgctcgtttgcataatctatatacgccggtgtaatatcaataccggtaacatcatacccacgtctggcaaacttcagtgagtgccgaccaaatccacatgccaaatcaagtattttttccgtcccttttaactgcaactgattgattagaaaatctacttgtctgttggtatcttctacccatgacatattgtggatatccagagtccaatttttctgataccagtcttttttcattgctttcatctaaatttatctcctgcctttcatccttcaaaaatctgtcccggtagttttttcttttctaaatatggaaacgctctatcaaattcttctgcttcattttcatccaccagataccctgctggtgttgcatattcacctgttatgccatctagataacccgaaatcagttctttacataaaaagaatgaagcatcatccccttcttccagaccatggtaacgaataccaaattcacttgcttgtttaaatccgcttttcccataaaaatcaatatttccttcaaaacataatgctccgcatccaagttcttttgctttttctaaagaataatccagtaaaatctttccataccctttccttttaagctccggtgcaatacagatcggtcccatagtcataatgggaatacttctgccatcatcggctacaatcacagccttcataaacatattctgtccaatcagatgtccatctaatgtcataacaaaatccaactctgagacaaatgccgaatcattgcgaagctgatggagtacataatgttccagacagcctggtcgatcctcccagtctttgtaaaagcaatactctggataacggattttaatggcttcccagaaataccgggcatatccacagcaaaacagatcctctacggtataacactgacattctttcaactgatcttcttctgcttcgtaatctccgacgcttggtgttccattacaatacaggttaaatgccatacggacaattcgtaaacttccactggtctgccacccttcctgcaggcattccatttttacacatccagttttaaaattatagattttattcacattatttcttgtgtctctgtcgatacccaggcaataaaccaaaacccgatggtagacatcctgatatctgcattttttcagatattcctcataaaatttttcgtgttccctgctcttgaaagtaattgtgcgagaattgctattctctgctcttaacgctgtgtttgtcattttcattttcctcctgaatttttaatattttggtataaaaaagacactccatttctggaatgccccataaaaaatagggacacccgcttttaacaagtatccctataatctatcaatgatctgatagctctctattcattttcatatttaagattctttgtgttccccgtcccgaggtctaacgcaacaacaacggttactttcttcacaaggctcttttctttgtgattttcacctatttttttgaaactgaaaaactccacaaagtgcgtaaattcaaggatttctaggtatctttcctttgtagtcctaccacagtctccacatgctcggtccaactaaacatatcaactggcacagcgctttttgcctcatatccatgtttggttaaatattttaagtctcttgcaagtgtttccggattacaggaaatatacaccactttttcaggtgcaagtttaatcacagaacttaaaaatgcctcatcacttccggctcttggcggatccataaatacaacatcgactttcttgccctgtccagccagatttaccatgaattttccggcatcaccctgataaaatctcacatttttaattccatttcgtttggcattgataatcgcatcttttacagcgtctttatttaattctacactgatgacttcttttacatgactgcttgcaatcagaccaatcgttccgattccgcaataagcatcaatgactttctcttctccctgtaatttcgccattttaattgctttttgatatagtttttcagtctgtactggattgacctgataaaacgaagccggagagaggcggaaagtacaaccgcaaagcgtatcttcaataaatccttttccatataaagtgatattacgttctccaagtaccatgcttgtctttttgtcgtttacatttaaaataaccgttgtaatttcaggatgaagttttctaagagctttcacaaaattattttttgatgggaagattggagaagcacatactaatactaccattacctcaccgcttgcaaatcctctccttaccatgacatgacgtagtaacccatatccgctgtcctcgttataaacttttatcttaaaagattttaataagcctcggatatctctgataattgcatccgcagtctggtcttctatcagacattcatcaaccggaacaatacgatgtgttccttcttcatagactccggaaacaatactgccatctcgtctgtgtgcaaacgctgcattgactttatttctataatgatatggatttttcataccaataatcggttctaccagacagatatctttcaaaagttttctgatctgcttttgctttttctttaactgttcttcgtaagaaatcccctgccaactgcatccgccacatttttttgccactggacatactttttgttcttccattttataacaactccaattttatttttttgtttcattatatcagatttcctctttgcttaaaagctatgttattctgtactttttttacaaaatatgctattattttattttgtaaacttttataaacctattaaaagagaggaatacaaaaatgctccaaacaattgaagcagttaactctgctgtaaacaactttatctggggtgtgcctgccatgatttgtatcatcggtgtcggtctttacttaagtatccgtacccgatttttgcaaatccgcaagttcccttatgcaatcaaaaccacaattggacgtgttttccgtaaaagagaggcttctgatggcgcaatgactccatttcaggcagtctgtacggcacttgccgccacagtcggtaccggtaatatcgccggagttgcaggtgcaatcgcaatcggcggtccaggtgccgtattctggatgtggatttctgctgcccttggcatgtgcactaaattttcagaagttacccttgcagttcacttccgtgaaaccaacgcacggggagaactgatcggcggacctatgtactacataaaaaatggtcttggaaagaactggagatggcttgctgctttattctctcttttcggtgtcttaactgtattcggcaccggaaatgctacacaggttaatacaattacgaccgccatcaattctgcattattaaattatcatcttatcaacgaagatgctgtttccaccagcaatctgattatcggtattatcattgccattttagttgccactgtacttcttggaggcgtgaaacgaattggacgtgtaacggaaaaactcgttccatttatggcacttatttacattgtactgtcccttggtgtgattttattaaatttaaaccgtgtaccttctgtttttgcttctattgttgaaggtgctttttctccggcatctgtaaccggaggtgtggtaggaagcttcttcctgagcatgaaaaaaggagtctcacgcggtattttctcaaatgaagcaggtcttggtaccggttctatcgcccatgcctgtgcggataccaaaaaaccggtaaaacagggattcttcggtatctttgaggtttttacagatacaattgtaatctgtactttaactgcactggttatcttatgcagtggaacccctgtcggatacggagaagcagccggtgctgaactgactatttccggctttacttctacttatggaaactgggtttccattttcactgcaattgcactctgctgttttgcattttccactatcattggatggggactttatggtgcacgttgtattgaatatctgttaaaagaaaaatctatcaaaccatttatggttgcttattctctggttgccattatcggtgcaactgctgatttaggtctgatgtggagtgttgctgagacctttaacggtctgatggcaattccaaacttaattgctctgttcttactttccggaacggtggcccgtttagttaaacagtattttgaaacagaaggaaaaaccaattagttttttcaataaaaaaagccgaaagctttaaggggttaccttaaccctctcagctctcggcttttttcttactcttcccgttctaattgtttcagcagatatcttcctacaatccctgaaaatcctgccacatcccgaatataggcaaaatcttttccaaagatctttttttctgccggtaaatctttctcttctcctgcaaatactccaagcacacaaacacctttacttcgtaatttacgtacttcaaatgcagtatctgaaatcgcatactttccctgatagggttgtggatttcttgcatttggacggtttaaaatcacatcataaggtcgtccgtcacttagtacaatcagaatcttatgttcctcttcccgatttaacaattcatagcctgctgccttaattgccaacccatcgcggttattggaagacgtattatattcaaaaatattttcattggcacttctatcatcttcatattcccgaaaacggtgcaaaatcgtataatcccagaaggtgcaaaaactcataacccgatgtggaacatttgcgatgctcaatgcttcacttaaaatatatgcctgcatcgccacctgcccctgccgttttctctgtgagccacttgcatcaattaaaacatccactacaaaatcactgttatcgtaatttagttttcttaaaaacactcttgaatcatgacttcttccaactctccaaagacgtgacggcacaattcttcccctgtcagatattgtttcctgtacttcatcacgcatcaccagtgctttttttagcatatctgagagctgtcggatgttatttttcaccatcctgtgattgttataatattcatagcggtttttatctcgctgtttttttgcatactcatactgataattacgaagaaccgcatgttttaatactccttctgtaaaatacagactacagtcactatgaattccacgacataataacaggtttcgtcttttctcttcagtttcagaaagatatccaattccgtaatttcgctgaacgtaactgtgcatcttagaaagtgcctcttcatctacaaccaaaattttctttttctgacttgtctcttcttcggattcttctttctttgtctcctggtttaattccattttatccaaattggtcattgcttcatttatatgttccagataggtgccaaagctctcttctaatgcctcttcttccagataatctttccaggaaaactcggcaagctcttccagcgaaactgcaagtaccgtttcaagatttccataacgtttttcaaaattaggatctaccatagcgttatataacttatctatcgtgtgaatcagctctatcgtttcttttgcatcagaaagtgcctgaacctgttccataaatgctctcatccggtttgtagcaggctcagaaccgtttaaacattctttaaacagcattagcttcaaacgccctggctcagaagctgcaaggcgtgaaaaatccatttccagtatatcttcaagcgccttttttcggatttctttgactccttcccgctcctttgtaatccgctcggctaccgaccattcaatacaaagctgtgcaaggctcataagaggtccttcttccccatgcagatagattttcttcattaagtataaagaaagctcttctctgttaaaataacgtgcaaatgcgccctgtttgattccgtcataaagcccaactgcatgagaacgatgataactctcaatgtccggttttacatccagcgtataatctccacttaccgtccaaatcagatttttgatccggttttctaattccaactcaaattcttctctcattcaaatacatcccctggattccaggactccggtattcttgtctttacgacatcctgcacaatttccttctcaaaaatatcaaagcatttatttacaactcccattttcactgcaagggacggttttaatccgcaggaaatcgtgcgcagtgccccaatcatccctcgcaaatccaatgcttttgttgtaatctcgctgttatctgcctttaactgcaaatccaagaagagtccaatccattgctttaacgcttcctctttgatagttggaaatttcgttttaaaaacgtactcaagtgtctcttcattctgacccggcatatctatcacaaggaagcgggaaactaatgcttcatttaactcttttgttcctgcataaccataattcatcgttccgataaaacgtgttgcgtcgtccatctcaattttatcatatcccggcacatcaatacttcttctatgatcgagggtagcatgtaaaacggagactgcatcattttttgccatattaatctcatcaaggattccaaaaccaccatattcggcacaacggtagatacttccttttcttaatttgacttcattattttcaaaggtatctgtaccaattaaatctccactgtctgtattgacatgaaaggaaatattataaaccggtcttgcgaaaatccatgccagattctcagccagtatgtttttaccggttgcctttggtcctgttaagagcagattttctccctttaataaagttgcaattcccatctctaatacttcttttccaaaaaatgccatatctggctttataatacggtttttcaccctctcatccactttatgttccgcacgaaattctgcaaccgcttcaatcaatcccttatctactttttgttcctctaaaaccttaagttcttgttccattttctccatcctgtatttttttacttttattctattctatttcaccatatccatctgttggatttccaacatttttgaaaatcaggcgctacacttatcatagaataaatttttcatataactagaaaaggcatctggattttccaaataccctttcttttttctcaatttctatttttatacatcaaataataaatcaccataagatggcatcggccacatatctttgtcaacaatcatctcaagttcatcaaccggtgtacgaagtgcttccattgacggcattactttttcatgatagaacattgcactttcttttccttcttctttggtcagtgcttcttctgttactttctttaattcatttaatgcatcttttgttttctttaataaggcagaagtttctcttaagagttctgtctgtacttctacttctaaaacacctgctgcaacaaccgcattaatagaatctgcaagctgtcttgtatatttaattactgccggaataatctgtttgcttgccacatcaatcatagtcttagcttcaatattgattgcttttgagtaagcttcgtatttgatttcttttctggattccagttctgcttttgtaaatacaccaaatttttcaaacaattcaatggtctgttcgcttgtcagtgcttctactgcatctaccatacatccgatgtttggaagtcctcttcgttttgcttcttccacccattcatctgaataaccatttccattaaatacaattctctgatgctcagtaaagtttttctttatcaaatcatgtacagccatatcaatgtcttctgcattctccagtacatcgcagacttctttaaatgcttccgctacgattgtatttaagacaacatttgccggtgcaatagaatctcttgaaccaaccatacgaaattcgaatttattaccggtaaatgcaaatggtgacgtacggtttctatcggttgtatcacgcataaattccggaatggattttacaccggtctctaatttttcacttccgatactgtggtcagccatacctgttgtaatcagctgattcataacgtcagtcagctgagttcccaaaaatacagaaataatagccggaggtgcctcatttgctccaagacggtggtcatttccaacatcggctgcagactcacgaagcaaagctgcatgtttatctacagcttttaaaatacagcttaataccagtaaaaactgcacattttcatgcggtgtatttccaggctctaacaaattcacacctgtatctgttgtcaaagaccagttattatgttttccggaaccattgactcctgcaaacggcttctcatgaagcaggcatttcattccatgctggcttgcaacacgttttaaggtctgcataataatctgattgtggtctacttccacattgacttccgcataaatcggagctaactcatgctgtgccggagcaacctcattatgctgtgttttagaagttacgcccagtctccataattcttcatttacatgtttcatatatccggagattttctgacggattgttccaagataatgatcatccagttcctgaccttttggcggcattgcaccaaataaggtacgacctgtgaaagtcaaatcttttctctgcataaatttcttctcgtcaaccagaaaatattcctgttctgcacctacagaaggaatgactttttttgcagttgtgtctccaaacagacggatcagacgcattgcctgtttatcaattgcctgcatcgaacgaagcagcggagttttctggtcaagtgcctctcctgtataagaacagaatgcggttggaatacataaagttgcccctgctgcatcatgtcttacaaatgccggtgaagtacaatcccatgctgtatatcctctggcttcaaatgtcgcacgaagaccacctgatggaaaagatgatgcatccggttcacctttaatcagttcctttcctgaaaagctcataaggacttttcctgatggaagcggtgcagtaatgaacgaatcatgtttctcggctgttactccggtaagcggctgaaaccaatgtgtataatgtgttgcacctttttcaatcgcccattctttcatctcatgtgcaatgacatctgccatctcaagagacaattcttttccctccagaattgtctgttttaattccttatatactttttttggaagtcgctgctgcataacagaatcgttaaacacatcttctccaaaaatttcagtgactttaatgttttcactcattcgactatcctcctgtattatgtgcctaaaagctgtttctacgatacctcatataagaaaaaaaagcaagtggaattttcagatatcgcttaccaaaatgcaaagaaagctaaaagtaaaagacaaatcccaccaatccaggacaagtcttttttataaaactttgcacagcattttccaagtttccacccgatttccatcataaaaatcccaaaaagaaatgcccctgcaatcagcatccagcgtactccctctaaaagtcctgctcccatcccaactgccacactgtcaatagacagtgccattgccagaataatcccactcataaaatttaattttcttgtttttttcgtcgtattttgctttcgtatccgaacagagtgataaatctgatatccccccattccaccaagtaaaacccctgccagaatatctgttgtcctgccttcgataaaataagaaaaaccatttcctatccagaccgccattcccaacattccgctcataaccagattcatccctgcaactaccgaaaatgaaattttaatacggcttgccccatacgaaaaactgaccatgaatgaatccatggtcagtgcaaaaatcaatatactgtttttcaaaaaatcctctatattcatatccgttcagcatccactttttttattatactatgataataaaaagaaaaagtccgatgccttttacgttttatttactgatacagcataaattaagcagctgctatattgatgccaagcgactttttgctatacaaggcagaaaaataaaacatcagacacatcaatatggcggttacttaatattctctgtattagcctgaatcaacggcactttctcatcttttttcaatataatgttcaccgcatgattcatattttggatttccacctctcgatgttctccaccaaattctccatccaaagtccaggaaatctgtgtctccgaagtaattttaaggtaagaagtcttaaaagactcaatgttggaagtatccgctcctcctaaaagagctgtaataatctcatttaactccagaatatttttcggacgacgtatcagtaatacttcaaacacaccatcatccagcaatacatctggtccggttagttttcggaatccaccaacggatgtcgcattgctgaccattccgaaaataaaatctccctcgaaactggtatcctttgtttctaccttaagctgataagaagcaatattaaataatctctgtgttccttctaatatataggctgcatgtcctaaaatattttttaagtcctgattagtctcataagaaacatctgtaaataaaccaaatgctgcaatataaacaaaaaagtcatcattaaatttcccgacatcaaaagcatgtggaatgccctctacaatatctgtagccgcctgtaacatattttttgaaacatgaagactatttgcaaaatcattcgtactacctgccggtatgtaaccaagtaacgttttatgatttccctccatcaatcctgttaccacttcatcaagagtcccatctcctccacttgccacaatcaggtcgaaatcccctgctctttttttcgcaacccgaagtccatcctgatatgcctgggtagaatgtactgttacctcatatccgccttttataaaaatatctataatatcaatcagacgtgatttaatacttccttttcctgctcttgcattaaaaataaacagtaattttttttccatacgtctttctcctatagaactttacttttctaattgatagaacaccactttgtacaagtataaaatcaggacaatacaaaaaagaacatacaattccggtgcagccatactgttaccggaggtatgttctttttacttcagcctaaggctgcattatcttttcaatttgtccacaactgaaattatactaattctaatacaacttccattgctgcatcgcccttacgtggtccgattttgatgattcttgtgtaaccaccgttacggtcagcgtattttggagcgatttctgtaaacattttatctaccatgtctacatcttttgtatttttctttctaccagcagcagctgttggaacttcttttaccgggtagaaaacttttaacatctgtcttctggcatgtaatctggacggagcatcttttttgatttctttctgaacttcgtcatatacagttacttttttaccatcaacaacttcttttactctttttccactttcgtctttacgagcaacttttgcagttactgtaacagtttcaaaattgtctttttctttcactgccattgcaataagaccttccgcaattttgcgaacttcttttgctctggtttcagttgtaacgatttttccatgatataacaggcttgttacctggcttctcagtaacgcttttctctggtcagatgttctacctaattttctatatttagccattttaatatttcctccatttgtggaacaatgagccatgcttcttcggtcttactggctcattgcttatattccataaattctctttacttggtttactcatcacttgggttcaactgtaaacctaactcttttaattttgcaagtacttcttcaagtgatttacgtccgagattacgaactttcatcatatcatctgaagtacggttgcaaagttcttctactgtattaatgcctgcacgttttaagcagttataagaacgaacagataactctaattcatcaatgttcatttcgagaactttttctttttcattatcttctttctcaatcatgacctctgctgtttttgcactttcagacaggtcaataaagaggcttaaatgctcgctcaggacttttgctgcaagactgactgcctcatcagcatccaaagtaccattggtataaatatccagtgtcagtttatcaaagtctgtaacctgtccaacacgggtattttcaacagtcatatttacacgctctaccggagtataaattgcatcaactgcaatcacaccaatcggcatgtcgtccgtttttcctttatcagagctaacatatccacgaccttttgtaattgtaagttctgcattaaacttacatcctgctccaccattcaatgtagcaattacctgatccggattcaggatttcaatatcctgatctgcctggatatctgcgcccttaacaacgccttctccatcaaactcaatatatgcagtttttggttctgcgctgtcacttgtgttcttaattgccaggtttttcagattcatgataatctctgtcatatcttcttttacacctggaatggaactgaattcatgcagaacaccatcaattttaacctggcttacagcagcacctggtaaggaagaaagcataattcttcttaaagagttgccgagtgtaataccataacctctttcaagtggttccacaacaaatttcccatatctcttatcatcagacatttctgtgatttgaattttgggtttgttaaaatcgaacatgcaaagccctccttgctacgtgcatcttatttagaatataattcgacgattaacatctcatcaaccggtacgtcgatttcttctcttgtaggaagtgctttcacttcgcctttcagagcttcctgatcaacatctaaccaagccggtacaagacgtccgcctgttacttccacgatatctttgtatctctgggaagatttacatttttctttaatttcgataacatcgccaacttttacaaggtaagatgggatattaacctgttttccgttaaccattacatgtttgtggtcaacaatctgtctagcttcttttcttgttctggcaagaccaagacggaaaactacattgtccagacgagtttccagcataatcatcaggttttcaccagtctgaccctgtttctgatcagcttttttatagtagttacggaaaggtttttccagaacaccatagatgaattttgctttctgtttttctcttaactgaagtccatattcggacatttttctatttgctctttttaactgtcttgttgattttttgtcaattcctaaataaatcggatcaagaccaagggatctacatcttttaagaactggtactctattcactgccatgattaattaacctcctaattagactcttctacgttttggtggacggcaaccgttatgtggtaccggtgttacgtcgcagatgcttgtaacttccagaccgcaggcagacagcgcacggattgctgcttctcttcctgaacctggtccttttacgaaaacgtcaacagtcttaagaccatgaattaatgctgcttttgtagcagtctctgcagccatctgtgctgcataaggagtagatttccttgaacctttaaatcccagaccacctgcacttgcccatgataaagcatttccttcagcatctgtcaatgtaacgattgtattgttgaaagatgactggatatgtgcctgtccgcgttcaacgtttttcttaacacgcttttttgtcactttttttgtaactttagccatttctaaactaacctactttctcaaatatttcaaatcatcatgttatcatttgctttaatttttcatctaaaatttaaagcttaattattttttcttattagcaacagttctcttcggaccttttcttgttctggcatttgtttttgtcttctgtccacgaacaggaagtccttttctatgacggattcctctgtagcatccgatttcctgtaatctcttgatgttaagagcgatttctcttcttaaatcaccttctacattgatgtttaattcatcaattgcatcacggattttaccaacttcttcgtcagttaaatctctgcaacgagtatcaggattaattcctgcctgctctaagatacggtcagcacttgttctaccaattccgtagatataagtcagaccaatttcaacacgtttttctcttggtaagtctacaccagctatacgagccatgtacttgttcctccattgttctaataaatattgttcctaattgagacacattgaaaatgacggtttcatgtgtccagccgcaaataaatttcacgcagcctttccgaatcatacagtccggtattaagcaatattctgcaatcatcctctcggtaggacgacaaacgtgataatattactatatttaatcagtataaacaacgcatccacgtggttcatactgcagccgcactaaaataaaactacacaaacttttcctcgtctaattaaccctgacgctgtttgtgtttcgggttttcacagataattctgatgctaccttttcttttgataactttgcatttttcgcaaatcggttttacagatgctcttaccttcacggaataaccctcctttcgtatttttgctgtgctctgattcgagggcaaaaatgcccgagcacaaaagtacgctttatataatagcactacttacataagattgcaagtgtttttttcaaatttttagctgcatatctttgtacttttttcagtacagatatgcagctattcttgtctgtaatcttatttatctctccagataattctgcctttgctcaaatcatacggagacatttcaattgttactttatctcccggaagaattcgaataaagttcattctcagttttccactgatatgagccagaattacgtgtttgttttccagttccactttgaacattgcatttggtaatttttccagcactgttccttctacttcaataacatctgcttttgacataaatcaaacctcctgtccgcttttgcggtttttcaatactctcttgatacgctcatttgttaattcatttccctcatcgagaagcttctggatttcgggagcaatttcataggcgacctgaatatgttttacttttttctttttctggttttcaattgtacggatttttccgtctgccagataaacatattcaccttctgctttcattatcatgtatctttttcctgtatcatgaccggcaagtgatacagccgtcattccggttccaagttttttcattaaaccgaacctcctattttgtaaaagtgagaatttccggctcaccatccgtaattaatacagtattttcataatgtgcagaaagggagccatcctctgttacaacggtccagtcatcatctaaccattctacatcggctctgccctgattaatcattggttcaatcgcaagagtcattcctgcctgcagtttcagtcctcttcgtctctgacggaaattcggaatttcagggtcttcatgaagacttgttccgattccgtgtccaactagatcgcgcacgactccgtaaccgaatttttctgcataagcaccgattgctgcggagatttcatataaatgatttcctgcttttgcaaatttaattccttcaaagaaactctgtctggttacatcaatgagctgttgtgcttcttttgatattgttcctacagcatgtgttcttgctgcatctgaatgatatccctgataaatcagacctgcatccagacttacaatatcaccatcctgaagaattctgtttgcttttggaattccatggactacttcatcattaactgagacacagatggatgccggatatccattataatgaaggaagtttggaatacatcccatctgacggataatcttttcacctaactggtcaatctcaagagtagaaactcctggacggatgaagttttcaagttcatcgtgtacctgctctaaaagccttccggcttcacgcattttttcaatttctctggcagtttttatcgttactgacatttttacgctcctaaaatctcgacgattgcttggaatacatcttccatatcaacagtaccgtctacttcttttaacacaccggatttagtatagtaatcaattaacggctgtgtctgatcatggtaaactccaaggcgtttctgtacagtttccggtttgtcatcgtctcttaacactaatttttcaccgcaggcatcgcagactccatctacttttgtcggattgtatttaatatgataagttgcaccgcatccaacacaggctcttcttcctgacatacggtttacaatgttttcatccggaacctccacattaattgcaaaatccactttttctcctcttttttcaagagcagcgtccaggcattctgcctgcggaatggttcttgggaagccatctaagatataaccgtctttacagtcatcctgtccaacacggtcaattactaaatctaccgttaattcatccggaactaacagaccctggtccatataagttttcgcttttttaccaagctctgttccatttttgatatttgcgcggaaaatatctcctgtagaaatatgaggaatgtgatatttttctgcgattttctttgcctgtgtaccttttccggcaccaggtgcccccaacataataattttcatacgcttttccctttctgtaatgcttttttactctttttttacattttccttatatagcattttagtgcacccacaaaagtgggtacacttccataatgttatgcctattcacttaaaaaacctttataattgcgtaccaacatacgtgattcaatttgtttaagagtttccagtacaacaccgactacgatgatgatggaagttccgccaaatgaaacatttgcaccgaatacaccgttgaagaaaaacggaataactgctacaattgtaagtccggcagctccaataaagataatgtaattcaagatattctcgagatactcctgtgttggctttccaggacgaattccaggaataaagccaccctgctttttcatgttatctgcaacttccatcggattaaatgtgatagaagtataaaaataagcaaagaaaataacaagtacgatataaagaataagaccaattgaatataccggttcatccggattaaaccaattactggaagaaagtccttttaaaatcttgcttccgattcctgtaccgttgcctttatttaaaaagctggcgataataaccggaaaagacatcaaagaagaagcaaaaatgattggaataacaccggcagtatttactttcagtggaatattactggactgtccacccatcatttttcttcctaccattttcttggaatattgaactggtattcttctttctgcaccattcaggataagtaccataacgactaccagaataatgattgccgctataatgattactgacaaaccacctcttgcgatggttttgccttttacgaatttgtcaaacaaagtaaccaaatcacttggtattctggaaacgatgttaatcataagtacgatagaaataccatttcctacacctttttccgtaatctgctcgccaatccacattaacatagcagaaccggctgtcaaagtggcaaccgcaacaactacgcttgtgaaattcatgtttgtaagccatcctctgtttccaaatccgattgccattgtaacggactggaacagcgctaaagctattgtcacataacgagtgatggcagtcattttctttctgccctcttctccatcacgctgcatttcttccagcttcggaatcgcaatcgtcaaaagctgaatgataatggatgatgtaatgtacggtgtaatactcaatgcaaaaatagacatggtctcgaaagacccacctgtaaatgcattgaaaaagttaaacgcatcgtttgactgatttgcaaacaattgtttaaagaaatctctgtcaacgcccggtattggcagctgtgagccaatacggacgataacaagcattaacactacatagtaaattcgacgtcttacatcttttatcttaaaagcatttttaagagtctcaagcattagatcacctcgacagttccacctgcagcttcaatttttgttttagcgctttcacttacagcgttaacttttacattaactttctttgtaacttcaccgttaccaagaagtttaacgccatctccaagacgagagattgcacctgaagcaagtaatgctgctggtgttacctcagctccgtcttcgaatctgtttaattcgcttacgttgattgcaacgatatctttagaatttctacatttgaagcctctcttaggaagtcttctgtataaaggcatctgaccaccttcaaaacctggtctcttagcgcctgaacgtgctttctgacctttatggcctttacctgctgttttaccatttcctgaaccatgtccacgacctcttctgaagttgtcgctctgtctggaaccttcagctggttttaagtttgataaatccatgatggcacctccttcttaatgattagatttcttctactttaaccatgtgtcttacctgacgaatcataccacgaacagattcattatcaggcatttccactgttttgtttaattttcttaaacctaaagcttctactgtttttttgtttttcggaacagcaccgattgtagatttcaccagagtgattcttaatttatctgccatttttcagtcctcctatgcaaaaatctcgtcaacggattttccacgaagtcttgctacttcttccggagtctttaactgacttaaacctgcgatggtagccagaactacgttctgtttgttacgggaacccatacattttgtacggatgtttttgatacctgcaagttcgattaccgcacgagccggaccaccagcgataacaccagtaccttccggagctttcttcagaagcatttcagcgcttccgaatttaccgatgaagtcatgagtgatacttccgttttcgtctcttgctactgtaactaattttttcatagcgtcttcttttcctttgcggattgcttccggaatttctgccgctttgcctaaaccagcgccaacgtgtccattgccgtcaccgacaactactaaagctgtgaatcggaagttacgaccacctttaacaaccttggttacgcgcttgattgatactactttttcttctaattcaagctgactagcatcaataatagtacgtttcatgtgttcatttcctcccttattagaattctaacccagcttctcttgctgcgtctgctaatgctttgatttttccctgatatataaagccacctctatcaaagacaacttctttgattcctgcttcaactgctttcttaccgattacagttcctaaatatgctgctgcatcaacgttattggttttttctaattctgcttttacttctttctgagtagtagaagcggaaaccagagtttttccaatggtatcgtcaataatctgagcatacatatgattattgctgcggaaaactgctaaacgcggagttgtagctgtaccgctcagatgattacgtaatcttctatgcttttttgcgcgaactttcgctcttgatactttactaaccatttttgcactctccttaattatttcttaccagttttaccaactttacgtctgataacttcatcagcatatttaatacctttacctttgtaaggttccggtcttctcttatctctgatttcagcagcgtactggccaactttttctttatcaatacctttaacaacgatcttgtttccatcaactgtagattcaagaccttctgggtcttccatttctaccggatgagaatatcctaaagaaagaacaagtttctttccctgtttctgtgctctgtaacctacaccgttaacttccagagctttttcatatccctggcttacaccgattaccatattctgaatcagtgttcttgttaatccgtgtaaggatttcattttctttaaatcgtttggtcttgtaacaactacctgaccatcttctaatttgattgacatttctgttggtaacgctttttcaagtgttccttttggaccttttacagtcactacattgttctcagcaattttaacttctacgcctgccggaactgctactggatgtcttccgatacgtgacattcttaatttcctccttacttaaattttcggaaaggcctattatggttcctctctgttttcagtacttcttcgtctgctgtacttagcttagattaccaaacaaatgctaatacttcgccgcctacatgcagttttcttgcttctttgtctgtaataacgccctggtttgtagacagaatagcaatacccagtccacccagaactctaggaatttcctggcttcctgcatatacacgaagacctggtttagaaattctcttaagacctgtgataattttttcgttcttgtctgcaccgtatttcagtgtgatatggattgttttgaatactccatcttcaagaacttcgtattttgtaatatatccttcttttaaaaggatttctgcgatagcaagtttcattttagatgccggaacatctactgtgtcatgttttgcagtgtttgcattacgaattctagtaagcatatctgcgattggatcgctcattgtcatgatagtttcctcctataatttagacttttcatgtgaaattaataatttatattgtaacgacccggcactaagtgaagtctgccgtaaggcgaagacttctcttaagtggcttatggtcacttacttacattttcggcttaccaggaagcttttttaactcccgggatctgacctttgtatgctaattcacggaaacaaattctgcagattccgtattttcttaaataagcatgtggacgtccacagattctgcaacgattgtattctcttgtagagaatttctgtttacgctgctgttttactttcattgctgttttagccatgaattttccctcctataattattttgcgaatggcatgttaaataatgtcaataattcacgggcttcttcgtctgtctttgcagttgtaacgaaaataatatccatacctcttactttatcgactttatcatattccacttccgggaaaattaactgctctttgattccgagtgcgtagttacctcttccatcgaatgcgttaggattaacgccgcggaagtcacgtactcgtggcagtgctaagttaataaggcggtctgcaaattcatacatcttttcgcctcttaaggttactttacaaccaatcggcataccttcacgaattttgaagtttgcgattgaatttttagcctttgttgtaacagctttctgacctgtgattaattccatatcagctacagctgcgtctaacagtttagcgttatctttggcttcacctacacccatgttaacaacgattttgtcgagtttcggcacttccatgatattcttataaccaaactttttgatcatagcatctacgatctcatttttgtatgtttctttcagtctgctcactttaaatggcctcctctcttattaatcgattactttgcctgtagttttggcgaaacgtacttttttgtcaccttccattttgaagccaacacgagttgctttgccttcatgcataaccattacgttagatgcatcaagccatgcttctttctctacaataccgccctgctgatttgccatggatggttttgtgtgttttgtgaccatatttacgccttctaccagaacagcaccttttttcggattaacagagattacttttccttctttgtctttatctttaccagcgataactttaacagtatcaccttttttaattttaaatgttgacatcaggtacctcctataatacttccggagctaaggaaacaattttcataaactgtttatcacgaagctctctagctactggtccaaaaatacgagttccttttggtgttttatcatctttgatgattacagcagcgttttcatcgaacttgatgtaagaaccgtctttacgacgaactccttttacagtacgaactacaacagctttaactacatcaccttttttaacaacgccacctggtgttgcatctttaacagtagcaacgattacatcaccgatgttcgcatatcttcttgtagaaccacccataacacggatgcagaggatttcttttgcacctgtattgtcagcgactctaagtctactttcctgttgaatcatgcttagattcctccttacgaattatttagctctttctactacttcaacaagtctccatctcttatctttagagagcggtcttgtttccataacttttacagtatcaccgatatgacatgtgttttcttcatcatgtgctttcagtttatatgttctcttcacgatttttttgtaaagaggatgttttacatggtcttcgatagctacaacgatagttttatccatcttatcgcttactactttaccaacacgtgtttttctaagatttctttccacgattatgcctccttaattattcgctgtgtttgccttctgagcaatcagtgtctgaattctggcaatatttctgcgaacctctttgattctgcttgtattgtctaattgattggttgcattctgaaatctcaaattaaagagttcctttttagcagctactaattcttcctgtaattctgcagctgattttgtctttaaatcttctacataatttttaattttcactgttatcaccgccttctaagtctgcacgagaaacgattttacatttacatggtaacttgtgcatagcaagacgcaatgcttcgcgagctgtttcttccggaacgcctgcgatttcgaacattactctgcctggctttacaactgctacccagtattctaaggcacctttaccggaacccatacgtgtttctgctggttttgctgttacaggtttatctgggaaaattttaatccaaactttaccaccacgtttgatataacgtgtcatagcaacacgggctgcttcgatctggttggaacgaatccagcatggttctgtagaaaccaaaccgaattcaccgtaattgattttatttcctctagttgcttttcctctcatggtaccgcggaattgtttacgacgttttactctttttggcattaacataattatttatcgctcccttccttagttcctttagttggaagtacttcgccattgtagatccatgctttaacaccaactttaccataagttgtgtcagcttcggcgaaaccgtaatcgatatctgctcttaatgtctgaagcgggatgtttccttcgctgtagaactctgtacgagccatatcagcaccaccaagacgtccggatacggatgttttgataccttttgctcctgctttcattgttctggacattgtagatttcattgcacgacggaaagaaatacgattctctaactgaagtgcgatgttttcagctactaactgagcatctttatctggtctttttacttctttaatgtctacaattaattttttatctgtgtatttctgtaattcagctttcactttttcgatttctgaaccgcctttaccgattacaacacccggtttagcagtatagataatcactttaactctgtcagatgctctttcgatttcgattttagaaacacctgcgctgtataatttctttttcaggaaagttctgatgttgtagtcttcaactaagttatcagcgaaatctccttcagcgtaccatttggaatcccaatctttgataacgccgactctcagtccatgtgggttaactttctgtcccatgatagtcctccttatctctcatccaacacaacggtaatatggcagtttctcttttcgattctgtatgctctaccctgtgctcttggtttgattctcttcatggtcggtgctttgttagcgtagcactctgcaacataaaggttctctgggttcattccattattgttttcagcattagcaacagctgattccagtaattttttgattacgctggaagcgtatcttgggttgtatgttaagataccaagtgcagtctgaacatcttttccacggattacatccagtacatagcaagctttctgtacggacattctagcgtaggataattttgcagacggtcttgtatctttattagcatttcttgctcttttgatctgacttctatgtcctttagccatgataaaagcctccttctaaaatattagcgaacacctgattttttctcgtctttgccgtgtcctctgtatgttctggttgcaacaaactctccgagtttatgtccaaccatatcttctgtaacatataccggcacatgttttcttccgtcatggacagcaattgtgtgtccaacgaatgaagggaagattgtagaacgacgtgaccaggtcttaataactgttttatctccagcagcattcatagcatctacttttttcagtaagctttcatctgcgaaaggtcctttttttaatgaacgagccattagtcttacctccttattttgctaatgttttaccatctcttcttcttacaatatacttgttagactgtttgtttttctttcttgtcttcaagccaagagccggtttaccccatggagtacatggacctggacggccgataccggtcttaccttcaccaccaccatgtggatggtcattcgggttcattacagaaccacgaactgtaggtctgatacccatgtgacgtttacgtcctgctttaccaatgttgataaggctgtgctcgccatttcctactacaccaatagtagcacggcagttaatcggaaccattctcatttcgcctgatggcagacgaagtgtagcgtatttaccttctttagccattaactgtgcaccgttaccagcggaacgaactaactgtccaccttttccggcgtacatttcaatattgtgaaccattgtaccaactgggatttcagaaagcggcaggcagttaccaacacggatttcagcgtttgctccgttcataactttcataccaactttaagtccttctggtgcaaggatatatgctttttcaccgtcagcgtagcagattaatgcgatgtttgctgttctgttcggatcgtattcgattgttttaactgttgccggaacatcatctttctttctcttgaaatcgatgattctgtattttcttctgcttccgccaccgcggtgtcttactgtgattttaccctgattattacgtccagcgtttttatttaaggacactaccagagacttctcaggtgttgatgttgtgatttctgtgaaatcagaacctgtcatatgtcttctggaaggtgtatatgggttataagatttaattcccattactgtctctcctttcattgtaacgccgtaagcgttgtgtaccaacgcatcctggcgtttgttgcctgcagttaaatattggattactttttcttaactgcacttttcatattttcagtcaaactcttaatcttataaaccttcaaagatttcaatatctttgctgtcttctgtaagagttacaatagcttttttagttttagctgttttaccaaatgtcataccacgtctttttgttttaccatcaagattcatagtatttacatttttaacttttgttccttcgaacattttttctacagcttctttaatcatggatttgtttgcttctgtatgaacaaggaaagtatatttcttttcgcccatagcagccatgctcttttctgtaacgattggtttcagaattacatcataatactgtacgtttgccattatgcgtatacctcctcaattgaagctacagcagattttgtcaggattaaagtgttgtatttcaggatatcaaatacgttgattgtatttgtgtatgctgttacaacatccggaatatttcttgtagataaaactacgtttttgttctcttcgttaagaactactaatgctttagaaacattcaggttatttaatactgtctgcattgcttttgtttttgcttcgtctaatgttaaatcttcaagaacgattaatttgttttcctgtactctgcttgttaaagcggatttcagagccagtcttctttcttttttgttcattttaatgctgtaatctctcggtactggagcgaatacaacaccaccgcctgtccactgcggagatcttgttgaaccctgtcttgcatgacctgttcctttctgtctccacggttttcttccaccgccactaacttcagagcgtgttttagctttctgagttccctgacgattatttgcaagctgacgaacaacagctaagtgcactaaatggtcgttgatttcaacgccaaacactgcatcgtttaattccattgttccaacttctttgccttccatattataaacagatacgtttgccatctgtgtgttcctcctttccaacgaaaactttatttaacagtcttaactgtttctttgattgttactaaggatttcttaggtcccggtacagagccttttacaagaatcagattgttttctgcatctacgcttacaacttcaagattctgaactgttactttaacatgtcccatctgtcctggcatttttttgcctttgaatactttacttgggtcagatgcagcaccgttagaacctgcatgacgatggtatttagaaccgtgagccataggtcctctggactgtccatgtcttttgattgcgccctggaaacctttacctttgctgattgcagttgcgtcaactttgtctcctgctgcaaaaacatcgcatttgatttcctgtccgagtgccatttcttcagcaccttccagtttgaattctcttacgaatcttttgtaggaaacaccagctttatcaaagtgtcctttaaccggtttgttaacaagtttttctctcttgtcagcgaaaccaacctgtactgcactgtaaccatcattgtcctgtgttttaacctgtgttactacacatggaccagcctgcaatacagttactggagttaaaactccgtcttcgttgaagatttgagtcattccgactttagtagctaaaattgctttcttcattgtttacctcctgtgattctacagcggattacactgtgttgtgcaatcatcctagacagaaagttaatatatttatatcaaccttgtaaggataatttctcattaaaaattatttctgtttcatcttgatatcgatggaaacacctgccggcatctctaaacgagacagggcatcaactgttttctgtgttggtgtgatgatatcaatcagtcttttatgagttctctgctcaaactgttctctggaatctttgtatttgtgtaccgcacgtaagattgttactacttcttttttagtaggaagcggaaccggtccactcacagttgctccattctttttaacagtttcgataattttgcttgcagacgcatctactaactgatggtcataagcttttaaaacgattctcattacttgacttgccataaaaaaagtctcctccttttcgcactttataagtagtacgacaagcggcgactgtacacattcccgtgtgtgtcatctcatttttacacacactcccacatacccgtggtaagtcttcaagattttgtacagtgacttgtcgtcagtttcctaacatgacattcgctccacggaaaacctgccttttcggcagcaacctcgcgcttcatagctatcaatgtcacagcaagaatgagtatacacgattcttcaaaataatgcaagagttttttttaatttttttatttttttttgaacacaagaaaaggttcctatgacaaagtgtttctacgcaacaaaaaaagagagtcgaaactctctttcttcgctcctatgcttcttatatacagttctatatatatagaaacattttagaataaattcgtataatccaaaagcgtcaccttattatctgaatcctcaatcacttccggatggtctccatgcgcctgtgcatttcttaagaggtcttctaccgatggactcggaagaacttcttctactacctcttctgcttttggttcttcttctgattctgaagtttcttcaccatgaacagcttctgattcttcagagttcatcttaacaatccccgcattcagtgcttcttcaatttttgcttcaagcccaatggtatcttcattttcttctggttttatttcttctgtctttggttcctctgtaggaaccaaaacttcaccggcagactcttcttgtgttccctctacctgctctgccactgtttctttttccgctgtttcttccacagcaggctcttctactgtttctcctgttcttaacagttctgactttaacaattctggttttaacacctgtgtcttttcgccggcaatttctttttcatctgccggcactactgttccctctttactcatctccactgcatcctgtaaatatgaattttcatctgactttggattctgctcgaactctgtctggatgttctctgttttttgaacagattcatactctttggcagtttccggctgtgcctcttcctgcttctcatttgtcggctcttcggaacgtttcgattcaagcggaatcactttttcttctgtgttcttttcttcactttctgattttgtttcttccatatcttttttatcttttctccacaattcggcaagaataaataaaataattaaaaagacaattccaagaccaatcaaaatcaatccttctttactttgaactgcaatcgctgcataagcaataagtggaacaacaaaagacagcttcataacatctccgctaagctctacactgcgttcttctgtctttttatcataagcatctttcaccagatacgtgtcattttctgcatccgatacatctgaaatctcataaacataagcctgattattttttgtataaacaatcttctgtcctttcttcagatttaccgcatccgtctgcttaccataagcaacagaaccgaccggaagatttgtctccgccgtactgttatcattcataaccgtctttactcctacaagaggaggtactaacaaagccgctgctataaggatggtacagatgataaccaggtccacaataagttttaaaaattttgacatctctgtttcctcatttcgcaattctttcatttcttatcttaacattttctgacaaagatgtacacaaaaactttaattgatattcaaactgatattctaatcagatatccgaaatgaatattctacagattcgtcagaaatgcctgatatcccttatatgcttcataaatatccactttacttgcaatttcccacggagcatgcatatttaatacggcaactccactgtcaattacatccatatcgtatgctgcaagaatataggcgatagttccgccgcctccaacatctacttttccaagttctgcggtctggaaagaaacattttgctcgtccatcacacgacgcaatcttgcaatgtattccggatttgcatcattagaaccgctctttcctcttgagccggtatatttattaaaggttaatccgtgacctaaaaatgcacagttattcttttccatcacttccggataatttgggtcaaatccggcgctgacatcagaagaaagcatgcaggaattttttaatgctctgcgcacaagcagttcactgtaagttccacacgcattcatcacttccgccaccgtattttcaaagaatctggaatgcataccggttgctcctacacttccaatttcctctttatctaccaacaaacatacagaagtatattctgcctctgtaactgcctcaatcgctttataagacggataagcacatactctgtcatcctgcccataagccataatcatacttctgtctaatccaaagtctcttgcttctccggccggaacaacttctaattcagcggatacaaaatctttttcttcaattccatatttttcttttaatatagaaagaatattttcttttacgccttcggtctcctctccctctaacggaatacttccaaccagtacgttcaaattttctccctcaataacttctgtcgcttttttctgcatctgttttgcagaaagatgaatcaataaatccgaaattccgacaacagggtcatctttggattctccgattaccacatttacttttgttccatcttctttcaccactacaccatgaagtgccattggaagtgtcacccactgatattttttcacaccgccataatagtgtgtatcaagcagtgcctgttctgcttcttcgtacaacggattctgctttaaatccaaacgtggagaatcgatatgtgctccaaggatacgcattccttcctgaattggtttttctccaattacaaaaagagccagtgcctttcccatattgttggcgtacaccttatcccctttttttaaagtttctcctttttcaataacagtatcaagatttttaaaaccggctttttttgcctgttttataatttcatctgtacattctctttctgttttgcataaagacataaattctttatagccctcgcagaaatcaaagactggtttcttatctgcatattttttccaagcattttctgttttcattctcttcacctcaatcattttattcttcctacagcttactacaccttcatttgaattgcaacctgccaagattgactttttacccagtttctatcataataagttcaagtcgaacgcatgtgagacttggcgcgtgatttttgtggaacatttatcttaaccagagaataagtttccgacggagataccgttattttgtacgaaaggattttgccttatgaagatgaaaataaagaccatagaagacctctctttaaatgcctggccttctcataaaattttaatttacgacggatggattatccgcttttcctgtttttatacccaccgcacaaactgtgtggagcaaatcggctcttcacagattgcgctctctgataagattgcctattgcgaagaagtctatgaaaaatggaatacacctgctattttcaaaattaatcctttaatggacagttcctttgaccagaaactaatggaacgaggctatcatattgcacataccacggaagtcatgacaatgagcttggaatcttatgaaccaaaagaaccacttgccgaggtttcccttactccacatattacctctgactggttaaatgctctttttgaaatgaacggtacaaccaatccgattcacaaaaaaattgttccttccatgtatcatgcgatcccaggagataccatttttgccactgtctatgacggtgataacgtcattggaacaggtcttggaattttagaccgtgattatgtcggcatctacgcgattcatgtcgctcccggttaccgcagaagaaaaatcggtcagtctatctgccgtgcacttcttaaaagtgcgagagaacaaggcgcctgttatgcctaccttcaggttgtaaaaggcaattttggtgctcgtactttatatgaatcacttggttttgaatatctttacacttactggttccgccagcagttttaaattttaaaaaataaaaaaggaactccgcagagctccttttttattttttgctatttattcaatctttttatctgtagaacaggcttccaagctgtaaatctctcttgaaatctctgattcttgtttctccatcgatataaacagcttcaattcccattgctgctgcccagtctcccatctgttctgctgtgatatcataagagaatgcggtatgatgtgctccacctgctaaaatccatgcttctgcacctgtagctaaatctggttttggtgtccagaatgcggttgcaaccggaagtttcggcattggtttttctgttttcttgcagtctacttcgttgataatcagacggaaacgatttccaaggtcaattaaagaagttgcaattgccgaacctgtcttagatgtaaatactaaacgtgcagggtcttctctgtcacccatagttaacggatttactttgatgctgattggaccatcagaaatagtcgggcaaacctctaacatgtgcgcttccaagataccttcttttcccggtactaaattataagtataatcttccataaaggaagttccttttgcatctttcattccggcagtcatgattttcatcaggcgaaccatagcagctgttttccagtcaccttctccaccgaatccataacctttttccatcaatctctgaatagcaagacccggaagttgttttaaggagcctaaatctccaaaatgagtaacgattgcctgatagtttttctcctctaagaaacgttcaaacccgatttcaatctgagcctgcgcagctacatgtttcttaaattcttccgggtctcttccctctaagagaatgtcgtatttgctgtagtattcttctactaaagcatctgtatcagctttggatactgctgaaactgcttctgcaatctcattaaccggatatgcatcaatttcccagccaaatttaatctgagcttctactttatcgccttctgttacagctacgtttctcatgttatctgcgattctcataacacggatatggctgctttccatgataccaattgctgtacgcatccaggaagcaattctttcctgaacttttttgtcgctccaatgtccaacgataacttttctttcaattcccatacggcttacgatatgaccatattctctgtctccgtgagcagactgattttcgttcatgaagtccatatcgatggtatcataaggaatttcctgattaaactgtgtatgcagatgaagcagcggctttctgtattcctgaagacctaaaatccaggattttgccggtgagaaggtatgcatccatgtgataacacctgcacattcttcatcttcatttgcttcattgaaagttcttctgattacttcgtttgtaattaaagttggttttaatacaacttcataaggaagtactcctgatttatttaattcttctacgataattctggaatgttctgcaacttttctcaagcactcatctccgtataaatcctgtgagcctgttgcaaaccaaaacttataattttttgatgctttcattttaaaaaaatctcctttcaccgttacgattttctctcatggtttttctaattcccatgatacagcttgtatggtcatctttacaagttgtatcacaagaaaacagacaagtttttcttgtgcacatacaagttctatttatacaaaaagaagaaagagtagacaaacaaaactgtttatccactctttcttcttttctttttcgttttcttcctgtatttcttttccgtcaaatattactctttaaaacaaaagcaattacttccgatttgataaataagcctcgatactcttcatcgcttcttcttcatcttcaccttctacagatactgttacactttctccagcatctaatccaagactcatcattcccataatactcttggcatttactttctttgcttcactctccagataaatattgctggaatactgacttgccacctgaactaacatagcgattggtctagcctctaacccatttgaaatgccgattgtaattggttttctgatcatacttgttcctccttacttcccctaagttcttctgctatcctgccaattttacgcaatctgtgattgactcctgactttcctactcttggatttaaccgttctcctaattcttttagggaagcatcctgatatttcaatcgaagttccgcaactgcttttagattgtccggcagtgtctgaagtcctaccgtattctggatatacctgatatcctgtgtctgctttaccgatgccgacaccgtcttgttaatatttgccgcttcgcagtttacctttcggtttacactgtttcgcatttccttaaggattctgacattttccagattcataagtgatacgcctgctcccatgattccaagaagctctactatctgtgctccctcttttacataaaccacttcgtgcctttttcgactcactgtcttagcctctacttcaaagctgtgaagcgtttcctgaagctgttctgcctttatcgaacttgtacagacaatttcaaagtggtaaaacttttccggatcactgattgatcctgcacataaaaacgcacctcttaaaaaagctcttttacaacaatttttctggattatcaacggatttaccagaccattaaatgtaatcggcattctgtcctgtgacagatacttcatagcctgcaaaatccgaatcgcctcatcctcacctggaatgtccactacatacttattatttttcctgtataagacatcccctattgaaaacactttacttattctaaatgttttttccaataaagtaaagtactttcttgcaacactttcgttttctgctaaaaaatgtaatgacagtctcttttctgctccatattttatctccccgccaaatgcaaacatcgccgcaagttctgctatctggcaatgccttgcagggctgataattccctccagttcttcttttacactcgccgaaaacgtcatctctttgcatccttttcaatgtctctatgctcaatccgaacaccatattccccatttttattcagtctgttatataattcattggcaagagttacacttctatgttttcctcctgtacatccaattccaatcaccagctgactttttccctcggaaatataatttggaattaaaaaccgcatcatatcttccagcttgtctgaaaatatgtgtgctaattcagacctcatcacataatcccgaaccgacgggttatttccggtctgaggacgaagttcctctatgtagtacggattcggaaggaaacgaacatcgaatactaaatctgcatcttccggaattccgtatttaaatccaaacgacaagaccgtaataatcatattttggaatgattgattatctacaaaaatcttttccagttccgcctttaattcccttgtcaaaagctggcttgtatccaaaatataatctgccgattttcttaaaaattttaaatattctctctcttttcgaattccctcatctactcttcccttaccggacagtggatgagagcgccgtgtttctttatatctttttaccagagttttatcatctgcatctaaaaataaaatttcaggttcaaatcccggaactctaaggcgttccagtgcctgctccagttccccaaatgccatcccgctgcggatatccactccaagtgccactttattaatgtctcctgaacctccgtcacgcaccagttgtgcaaatttatccaaaagcggaaccggaagattatccacacagaaatattccatatcttcaagcatctttaatgctgtactttttccggccccggacattcccgttacaattacaaaacgcatctttaaaactctcccaaaaattttatctcagtctccagtaaaataccgaactcatcctgtacttttttctgcactgctttcaccagatttaaaacatcctcagctgttgctccgcctgcatttactacaaaaccacagtgtttttcagaaacctgtgcaccaccgacctgaaaccctctcaagccggcatccataatcagttttcctgcaaaatgtccctccggacgtttgaaagtgcttcctgcgctcggtctgtccaacggctgtttgctgactcttttttcttttaaatcatccataactgccttaattgaatccgcactgcctttctttaactcaataactgcctctaatacaatataatttttctcttttacaatactgtggcggtatcccagctctaattcttcatttttgagtgttcttacatttccctctgtatcaaggacagttgcctctaccagcacatctttcagctctccgccataagcacctgcattcatgacaactgctccgccaagcgttcccggaattcctgctgcaaattcaaatccttccagagactgttcaagcgcacaggatgcaattttagaaagctgtgcccccgcctgtgcacgaatttttgtttcatcttctaccgatactttactcatatttttccaaatctgaatgactgccccgcggtaacctttatcactgacaaggagattgcttccatttcccagaataaaatacggtgtccctgtctccttacagacatgtattactgcttttaattcttccgctgtctgcggacataaaaaataatctgccggtcctccgattcgaaacgtagtatgtttttccatcggttcttctaacttaacattctcaattccaatacaatcaattaatttattttcaatttctttcttcacttttttacctcttaacttatattatgatgtactacagaaaagttccgaacgtacatgactcattctgtcaggtctgaaatcacctgcgctgctatcataaaccccgcaattccggaagaaaaagaaatactgttcacctgtgtacctacactggtctggtcttctttcaaaacagaacgtttctttttggaaaactcctgtgtagaataaaaaacttttatattttttgctttttgaatctttaattcctggcgaatttttctcataaacggaagattcaccgtcttagaaaaatctgctatgcgaaaacaggaaggattccacgcatttccaattcccatacaggtaattatcggcgtatgaaactttctcatctgctttaacaacaacaattttgccggaacatgatccattgcatctacaacataatcataagaggaaaaatcaaataaatcaatcgtgtcctctcctaaaaaagtttcataagtatggacaatcgcattctcattaatatccatgatgcgcactttttccacctgcacttttttctttcctattgtagaacgcagtgccacaatctgacgattcagtttcttcgctgacacctcaccataatctaccaatattaacgtccccactcctgctcttgccagcgcttcaactgcataagaacccactgttccaataccaaataccgccaccttaagctgatccggactctttcttttttctgttcctgataatccttccgtacgggagaatacgtggagcatacgtttccttcctcctaatgtttctatgaaatataaggatgccaaaatttccaagctcaattccaacatcattacgtttcattatactattaattttggaagttgtatagaactactttttcatctttggtttaaaaatcaggctcgcaagatagccaaaaatcagcgctgccgaaatccctacggcacttgattcaaaaccaccctgaaaaatgccaagcagtccctgctcatctaccgcctttttgattcctttccacaaagtatttccaaatccaagcagaggaacactcgcccctgctcctgcaaaatcaatcaatttctcataaattccaagtgcaccaagcaccgttccggtacagaccaacagcaccataactcttccgggcagaagtttcgtccggtcaagcagaatctgcaccagtgcacaaatcagtccgcccacccagaatgcattcagataatccataagttcgccctccacattgcgtattgcacatcttttttgcattgccaaatctattttaacaatgttcgattacaactgcctgggcaatcccaggcacactttttccctcattataacttactttagataacagtgctccagtcggtacaaacagcacccgcttccattcacctttttcaattttgggcagaatatacgaagcaaatgtcgtggcagaacatccgcatccacttcctcctgcatgggtgtcctgtgtttctttatcataaatttcgattccacagtccatcagctttgccgtaacatcatatcccttttctttcaataaatcaatcaaaatttcttttcccacttctcccaaatcaccggtaataatgcggtcgtagtcctccggttttcgtccaaaatcctccagattctgataaatggtatcgctcgcagccggtgccatacaggctcccatattcaaagaatcctttaagccgtaatctatgattttccctgttgtaattccggtaattcttgcttttccgccttttcggccaagcacacaggctccgcttcctgtcacagtccaggtagctgaaaacggtctttgatttccatatccaagtggaaatcgaaattctttttctgcacttccaaaatgacttgaagttactgccacaacataatctccatatcctcccgccaccgccatagaagcaagcgacagtgcttctcccattgtcgcacaagctccatacaatccataaaccggaatttcaaatccaataatcccaaaggaagaggcaatcgtctgtgccagcaggtctccggcataaatcatacggatttcttccttggagagtcccactttttttatcgccatcgatactgcttctttttgcaggatactttcggcttcctcccacgactggcatccaaacagcccgtcctcttctcctattttgtcaaaatattttccaagcggcccatctccctctttttttccaaccatagaggctccacttaaaatatgcactgcattatgaaataaaatactctgttttcctatcatctgttcccgttccatttttatccagacctccttatacgattccacattgtctaagcgtataataaatcagccccatcagtgctgaagtcaaaattccatacagaatcaccggccctgcaatgataaaaattttacacccaatgccgaatacctgtccttctttttgatattcaattgccggtgccgctactgaattcgcaaaccctgtaatcggtactaacgtgcctgctcctccccattttgcaagtcttggataaatattaaatcctgtaagaatgacactaaaaagaaccaggaggagcgaagtccagcttccactggtctgcgcatcaagcccctggctcttacaaatattcataattccctgtcctatcgtacagataatcccacctgataaaaaagcacgcgccatatttttcggcaaactgtgaacaggtgtcattttttttacgtactttccgtattcttcttgttgttttattttttcaattgcttctgctgtggtttgagtgttcttagccataccagtcaccatcctcttctatattcttgaaatttttctacagctcatttcaaaaatatatctttttactttaggattagtatggcttttcaaaggcaaaattattacttctccgcttctttttcttctccgtacaaccgttttgccctcttcaaacaatgataccggtctatcgacatcacaagtcccatttcagccataataataacgatagaagtacctccatagctaaaaaatgggagcggaatacctgtatttggaaataaattaatatttactgcaatgttaataatactctgaactccaatgtggaaaaagactcccatcgccagtacagaaccgtagacattttcagaattctttgccacctgataaatcaggtacaacagataaatcaaaagtccgataataactaatgcgcccaccagtccaagttcctcacagataattgaaaaaatcatatctgtatgagcttccggaataaatcccggcttcttttgtaccgaattaccaaatccctttccaaaaatcccaccggaaccaatcgcatacaaagattgaagcgtctgatacgattttgtcgaagcatatttctgtggtgcaagccatgcagcaattctcgccttacggaacgaatatgtatccgcattaatcaatgtttcacttggcagattaaagtaaatcgaaagcaccattgcaagactgacggctattacacagacaagtgcaactatttttaatttcggtgatttaatgcagaccaccgtgattaggtaagtaatcccaagtacaacaattgcagaactcaaatccctcgacaactgccacaacatcaccgccggaactgccccgactccccacaataaaaccacaaaataagaattattttttataattgtcggtctaatccagtcagctgcctgaataacctttgccgaccgcttctcaaaaatcttgtgtcttggcttcatataaacataccgtctttgaatcagacaggccaatgccaggatcacaaatacttttaccggctcagccacctgaaaggaaatcggtcctaactgaaaccagcgcttcgcaccgtttatctcttctccttttgcaaacacccataaaatcaatccaattccaacaagataccccactgtcgtaaaatgccagaatcctgtataattcaatttcggcaaaattaccatgcagactaatccaagcaaaataaataccatctgccgtttaaaatagtagaaagaatcataattatacttttctgaattcgcacaggtcgtactcgacgcagaataaatcataattgcaccaaaaaagcacaaaataagcgtcactgcccaaatttgaaactctcttctctttaccattgaaagatacttttcttttatctgcttatttcgttttttattttcttttttccggtttttctctcttattttatctctttggctttgattttgtttctttgagcccttttttttctcactttttacagccatcttttctctccccatgaatcgctaactttaatagattaacacaccggcagtttatttgtctatgtttatccgtaaaatcggtcaattcgttttatgagaaagtctggctttttcattttgattttgctcgttataaccctcaaagccctcttcaatttcttttaaaatctctgcataacgaagcagttctctttgaatttcttctttattatcacgctcctgtttataacagattcgatgctccatgcttgcccagaaatccatgccaatggtgcgaatctgcacttccaccggataatattctgtactttccatcgaatatacctgaatccccagaatcatgtgaaaactgcggtatccatttggttttggatttgtaatatagtctttttctttgactaaaatcaaatcactctgttttcttaactgttctgcaaggagttcgacatccttttcaaagtagcagataacacggattccggcaatgtcctgcaaatgctcttttgcattcataaaactcccctgcaaatccatgcgttttaatttttcttcgatacttgctttttgtttaatacgaaactgtatattatgaatcggatgtgatttattgccatacatggaatgattgagtacatcaagtctggcttttaaaagattcaatgcatcctgatacggcacaatcaagtcgtagtattgttcatttgtcataaaactttctttcctccggtcttaaaaacttacagcagtccgcccattctgctgccatgggttattataccatattcaatgccggtggaaaataaatcttccatgaaatttctatgaaactcttatagattttttatcctgtaaaatgcttctcctgatttccccagactcactatccttttcttaatctttaacaaaaaaactgaaccagacttccaagtacctttccaactgcaagcgataaaataaccagtcctgcacctttcgtaagaccgactcttcttgccataattgcaaatacattcacgacttctccaagcgcaatcacccagcttcccagaaaaatcccaaatccgattccaacaagagctacgcaccagatacccagattgatatgaatccgataaagtaaaaacagatttcccagaaaactgccaagcatcaggctgttttcataaaacagtaaatgatttccggtgtgtgtcactccggcatatctcggaatcattccaagtccgataataaatgccgccagagctgttgctacaaccataccgccacataatcccacaattccggccaaaagctctcttaacatcttattttcgttcctttcttttttcctgctcaatcagtgtcttattgacatcatcctcataaacccgcatttctacttccattggagtcgggtcttccgtaatctttctgccaccaaaatgattaaagaaaaagacaacaccgagtccgattccaattgaatacgatagttccaaaattgtttttccatttgaaactcttccggtgatctgctcatatactttcataaataaacctgccgtatcaacatccgtattgaaggtcataatcgaaaatgcccctccaaaaaatgtcacaagcgatacaaaaattgtttttaaccaggaatagaattgatgggcgtgtttctgtgtttcataagtcagaataaaatttgcctctccgatatgcgtcacatctacgctctcttcatttctttgaattaaatccacgatttccagtgcagatattacataccgccctggtttttcatttggaatcgtaaataatttgcgggctttatttcggtttaatacttttccattactgcatgacaaacttgccacatcctgaacgtaaacttcgggactgtgtacttctacatttttttcggtctgtatatataaaatatcactcatgttttctgctgctccttgccttataagatgcagaatttagtatttaacaaacgtctgaaaattatacctgaattactctggattactcctaatcaatccgttcccttaaaacttttaaaatctttttctccattctggaaacctgaacctgcgaaattccaagttctcctgcaatctgcatctgtgttttttcctgaaaaaaccgcagataaatcaattcccgctcttttgcctccagacttcccaaaagctgttcgagaagcattttatttaaaagactctcctgtccgttttccggttcttcgattttatcttccagtacaattccacttccatccccctgataaatcatcttctgcagggattcaatctgtgcacctgcctccattgccatcacgagttcttctctcgtcaccgcaattttctctgcaatctcctcaagccctggttctcttcctctttcggcaaatagtgcctcatgtacccgataagcctttgcattaatctcttttaaagaacggctgacctttatcattccctgatcccttaagtaacgcttgatttctccggttatcatcggaactgcataggtagaaaatttcacatcaaacgaacagtcaaatttatcaatggcttttaatagcccaatcgttccgatttgaaataaatcctccatctccactccacgatttaaaaatcgttttacgatactatgcaccagacccgtatttttctctaccagcgtatctcttgcttccttatccccttggtgtgcacgcccgataagggcaaggacctcatccatagcgcctccttattcttcaaagctttccctgcttatgccaattttctttctcatacgcacggttgttccttttcccacctcggattcaaccaaaagctcgtccataaatgcttccataaatgcaaatcccataccggaacgttcctggtccggtcttgtcgtaaacattggctccattgcctgttttatatcttcaattccctttccataatcaattatcgtaacaaacaactctcttttacctgtcttacattcaatcctgattttctcctgcttcttgttatcataagcatgaataatgcagtttgtaatcgcttctgatacggcggttttaatatctgcgacttcttctaatgtcggatttaactgcgttgcaaatgctgcaacggtcactcttgccagactttcattacaagaacggctgacaatttctaatgtcatttcattcgtatactccatttttatgctcccccttatctttttttctgatgccagactgtttcctgactgatttcaatatatttataaattccggaaatccgcataatccgatatacacggtcattcacatgaattgccgtcactcttcccccactataacgcacaatccgataccgtcccatcaacattccaattcccgaactgtccataaatgtcgtctttgaaaaatcaaataccagttgggaaatctcccctttttccagctcttcatccactaccttggtaatctgctgtgcaaaatgatggtccagctcttccggcacataaaccatcagacaattttcccttcgtttgattacatcactcatactgattaccccttactctattctttcaatcttttgtaaaaaaaggatgaatactcatcgtatccatcctttttctcaaggtttctcttttgatttttctattcttctgaatcttcttcactataatcagaataactgttatcctcttcatccgagttgctgtaatcttcatcattattatcattagaggtatcttcttcatcattattatcataattcgaatcatcctcttctgaattatcttcttcatcataatttgtatcgtccgaattatccgaggtatctgcctgactttgcgtctgactggattgtgaagaaccagaagaagaacttccccctgtcaatgcatctaaataatcctgcgcatcggatgcattctgtgttccagggaaggtatcaataatcttctgataccaggtctttgcattgtctgtatccccactcttctgataagcctgtgccagatagaacatcgaagtaaagtccggttctccgatatcaagcgcttttgtataattttcaatagcagttgcataatcaccgctctcataagcatccatcgccgtactttgatatttctgtttgacactggaaccaatgtctcccataatcgcatcgtacatactctttgcttcaacggaaagcaggtcactgtttactccttctaaggcatttgctgctgtctcataattttcatcattatatgcctgccatgcctttaaaagattttcatagctggttgttgtttcttttgcctgagaaatctggtctgtcgctgtatttacagattccgaagaattgtcaatttcttcctgcagacgagtcagttctgctgcctgtgtcgctactttatcgctgtattctactactttctgatttgctttttgattaatccgctgattctgtgccggaacaaccaaaaaccacaatgcggaagccccgaccaaaagcccgataatcagattgattaatgtattggtaacggtacgctcccgatattccattggttgaatgaccacgtcatttccggagcgataaacgactcttccttctttttcctgttttactttttctcttgccttaaatcttggctctaaatttgtaattttaccggtctgctgttctacttctcttaaaaaacgcagagtagtcgtattggtcttatcaatttttgccgctgatttcaactgctttcttgccttctcatattttccattgcgaatataaatcagtgccagtaaatgataacctttaatcagtttcggattgtccgcaagcacttttctaagctgcatctctgccatgtcgatactgcctcttttacagtattccagacattgattgtactttttgatactcatgttaatcgtatcaaggcggtttgcatttttctgcagacggttgatataatcagctgcgatattattttccggctgcatatttttactgattacccattcacttaatgccgcaaccacttcaccggtctcaaaataaaccagtccgagaagatttctcgcatgaatattgtatttatacattctaagacttctctgcaggcaggtaattgcccctgacaggtcacgaatctgtgctttttccaaacctctgttataatacaaattcgataatgcgacaatctgtttctgcaccgtcacattgcatccgcatccagggcaataggaagagctgttaagctgggtattgcatatcatacatttcatctatttactccctattttctggtgttcccttcagtttcttttaaaatttctttgagtatatccacaacatcagtcaaatcctgacgataaattgcattttctgcatcgtccacatcctgacacggctcaaatttttttaattcctcttcgtaattaatcatttgtttctcctttttaaatagtccttaatctctccaacgagatacaaagaacctacaacaaatagtaacccgtctcctttttttgcataagccagttcaaatgccttttcacaatccggttctgcatagacctgcttacaaccgttttctctaaacaattctgcaagttctgttgaagactgttttctgcttccccagatttctgttacatatacattggagaaatgaagtccattacagattttctgaatcatgtctttaaaatctttatcggaaaccgttgtaaaaagcagagtaattggataatcatcctggaaataccgaacggtttctacaaattttgcaattccatcttcattatgagctccatccacaatgacacctggcagtactgtttccattctgccctgccattttgtatgctccatcccggcttttaaggtttctttttcgattttatgaacttcttttaatactcccattgtttccaccgcaagagatgcattcatcatctgatattttgcaataaaaggaatgaacaagtctattgtaccataaattttagaatcgtaggtaaatgaaattccatccggtgtataagaagtcatcttctggcttgcctgttttacctcataatacggacaccctagttcttttgcccgatttttaatgactttttcggcctcttcctgatttccatcaaagataaccggaacacccggcttgataatgccggctttttcacctgcaatcttttcaatcgtatcgccaagatattccacatgatccagactgatagaggtaatcacgcaggcaagtggagatacaatcgaatttgtcgcatctaaacgtccgcccagcccggtttccagtaccagtaaatctacatctgcctcatcaaaaatgaccattcccattaaaaatagaaattcaaaataggttggatggtaatctcctgcctctacaagctcatctgcaagcgctttgatttttaagaaagcccgtaaaaatgcctcatctgaaaccatttcttcgttaatctgaaatcgttcattaatctttatcagatgcggtgaagtaaacaacccgcacttatagccgccttcttcaagcattgtggaaagaaacgcacagacactgccttttccatttgttcctgctacatgtataatttttcgttttttatccggacttcccagtaaatccagacactttctggtatgttctaatttatttttcgttgtaaatttcggaatttcttctatgtatgcaactgcttcttcgtaagtaaacaaaaattaatccttctttcttttgtcatttccctaaaaaatcaccgctccattcacaatgataagggtcacttaccattataatgaagcggtgacaatatgcaagcaaattatgtcggttgtaaactttttcttttactgtgtctcgacagtagtttctgacttctcggaagatgccccgttttccaccgcgtctgctttttcatctgtttttgtttctgtctgtccttctgtctgtccttctgtctgcgaacccatatctgtctctgttgtgtcttctgtggattcatctgtttgtgctttggatgtttcatgataaatctgtgtttctgtccgacttaatacctttcgggtagaactgttactgcggattgcgatatccacttcatctccatcctgtaaatcaccatctgtcagaagaagcgtcgtcggactgacatacgttacttccactaattctccattcacctcaagataagcagactgcgtgaagtttgtaccggtaatataatatctgccatccgaaattttttcaattttatctaaggttacttcttccactccaagatgcagcttttctttctgatatggattttttccgccatagacatactgttttccatataaaatatcatactgcagcatttccaaatctgcctgataattctttgtctgtcttcttgcctgatgataacggaacacatttccttcatgaattccaacacggttcatgacttctgctgccatctgataagcagcaatatttgcatctttcttttcaagctccatattatcccagattacatattctgtctggaacagataacgattctccatatcttctacggtcaatcccattgtcggaagatgatccccatacatgacaagcactacatcttcatcaagttgagataaggtatccgtcagttcttttacaaactggtccatctcataaatctgattacagtaatactcccatttattatttaacgcctctgtactcgaaccgcttactgtaatcttcggattttcaatcgtcggttcttccggataatctccatgtccctgtaccgaaatcgtataaatatagtccggatcatctgtctcatttaacgcctgcataatatattttgtcagatttcgatctctcatccagtcattcgggtttgtatcatcctgttccgacatatactcttccgaagtaaaggtatcaaatccaagatttgcaaatacactttttcttccataaaagttcgcctcattattatgaatggcatgagtccgatatcccagactctttaatacataaggtgcactttcacaagttgtttcttttaaaatactcttatatggatattcgccaggtccaaaataatgtaagctcattcctgtaatgctttcaaattctgtatttgctgtacctgcgcctacagaaggcactttataatatccggaagaatattccttcatcagttttctgaaatttggaatcgggtcttccgaaacatttaaataattaaccagtgtcggatcaaaaaaggattccagctgtaaaaagataatatttggtcttttttctcctgttttgggcagatttgattcactgtcctcaatttcattgattgctgattcagaataatctctcggacagctgattccggtattaaaaatcgtagttgccagacagtatggatatccataatcctgataagcaaatgcaatatttccaaagtaattggaaagcactcgtttatccagtgccagtctggttgttcctgcaaatgccagcactacaatcagcacaaacggaatattgacacggtaacgtaattttcctctgtatcttggcccttttacaaataaaataatcattgcaatcagcaccagtattgcaataatcattacaataacaaagaaaaacggattcaaatacttatttgcaatcttaactgcgtcggtaatcagatgtaaatccggtcctgtaaatggagtgacacggtttgccaaaagcacaccattaataattccaagtccaagccagaaaatagttaacaataccctcataaatactcttcttcttaccagatacactaacatagtggttgtaaaaataagaaatgagttatataaaaacactaacggtctttctgtcatatagctaaaagcttctgacacagaatgtctggagatggcctcgattacaaaatataagaccatcactccaaacatctgaagaggtactgacagaaagttcaaaattttgataaactgtttttttatggatttcaaatgctcaatctcctatcagccttgcttacttttcaagctgtttcagtctctcttttacctgttccatcatatttgtatatttttcaagttttgctttttcttctgcaaccttgctttccggagctttgcttacgaagcgttcattgcttaacattccttttacgcgggcaagctctttgtttaatttttcttcttccttgtgaagtctttctacttctttttcgatatctaccagttctgcgaacggcatatagataactgcctttgaagttacagcagaaacagcatcttcatcgattccggctttgtctgcctgtacaacaacttcacttgcataaccaagtgttccaaagaatacttttccattttcaaatgtctcacggattgcttcatcttcagaaacaacaaatacttttgctttcttgctcggcggtacattcattccggtacgcacattacgaatgcttctgactgcttctttgatgatttcaactgcttcttcatccgcttcaaaatcccatttggcttttctttccggccaggaagcaatcatgatagattcttcttccggacgaagagtgcagtagatttcttctgtaataaacggcatatatggatgtaataatttcagtgcatttccaagaactgtttttaaagtccaaagagctgctgcttttgtggtgtcttcttcattgtacaatctcggttttaccatttcgatataccagtcgcagaattcttcccagataaagtcatagactttctgaacagcaataccaagttcatatttatccatattttcggttacttcttctgccagtttgtttactttagaaagaatccatttatcggcacccgttaaagcatttaaatcaatttcctgcggtacttctgctttttccaggttcatcatgataaatctggaggcgttccatactttatttgcaaagttacggcttgcttctactctctcccagtagaatctcatatcatttccaggtgcatttcctgtcatcagagtcagacgaagtgcatccgcaccatatttatcgataacctcaagcgggtcaattccatttccgagggatttactcattttacgtccctgtgaatcacgtaccagaccatgaatcagtacatgatggaatggagtttttccggtctgttccagacctgagaataccattcggataacccagaagaaaatgatatcatatccggttaccagtacatcggtcggatagaaataatttaattcttctgtattgtccggccagccaagtgttgagaatggccataatgcagaagagaaccatgtatcaagggtatcttcatcctgtgtcagatgttcacagccacatttcgggcatacagacggcatttcccttgcaacaactgtttctccacagttatcacagtaataagccgggattctgtgtccccaccataactgacgggaaatacaccagtcacggatattttccagccagtgcatgtaaatcttatcaaaacgttccggaacgaaagtcaggttgccatcctgtaatgtcttgattgcagcctctcccatttctttcattcttacaaaccactgcggtttaatcattggttctacggttgtaccacaacgatcatgtgttcctacactgtgagaatgcggaacaacttttactaaaagaccaagctcttctaaatcttttaccattgcttttctggcttcgtaacgatccatgcctgcgtattttccacctaaatcattaatggttgcatcatcgttcatgatattgatttcttcgaggttatgacgttttccgacttcaaagtcattcgggtcatgtgccggtgtaatttttacacaacctgttccaaattctttatctacatattcatcagcgataaccggaatttctctgtctgtcaaaggcagttttaacatttttccgattaaatctttgtatctttcatcttccgggttaactgcaactgcagtatcgcccaacagagtttccggacgggtggttgcgatttcaacgaaacgaccttcttctccaacaatcggataattgatgtgccagaaaaatccatcctgatcctcatgttccacctcagcatcagaaatagaggtctggcagaccggacaccagttgatgattctggaacctttgtaaatatatcctttttcgtataaacggataaatacctctttgactgcttttgaacaaccttcatccattgtgaaacgttctctgtcccagtcagcagaagcacccagtttctttaactggttaataatttttccgccgtactcttctttccatgcccaggcatgttttaagaattcctcacgacctaaatcctctttattaatcccctgctcttttaatttttcgattacctttacttctgtagcgattgctgcatggtctgttcccggctgccacaatgcctcatatccctgcattctcttaaaacgaatcaggatatcctgcatagtttcatccagtgcatgccccatgtgaagctgtccggttacatttggcggcggcataacgatagtaaacggttttttatctctgtttacctctgcgtgaaaatatttattatcaagccatttctgatacagtctttcttcaagaccctttgggtcataagtttttgcaagttctttgctcatgactacctccttgtttttattggtttatttttttgcagacatttatcataaaaataaaaaagcctttacagataaaactgtaaagggcgaatgtccgcggtaccaccttgctttttaactctaagtctgttaacgcagacgacgcgtgaacacctacgcaggatggcttttctttacagtcccctcaccctttcagcattccggttccaaagctaccttccacttgttcctctgaaacgtgctttcagcattttgccgttctctctggcagatttccaaatgtactcctctttttcaacaccttttgctacgatacatcataatcataaaaaatctttttgtcaagcaaaaaaatgaaccggaagttccgattcattttacattcgctctttctttatttacgggggaagttttcttccccctgccgtttaatcagtcgcataattctataatgttcaggctccgagctttggcattccatacgaattccagatacaaaactttggcacggaagtttttcaccttactgctgttaagcaggtttcctggctcatggattaacgcttcgccgcccttctcatataattttatacaatgggtatctccggcgtcactccccatatacagtgaccggctcgctcaggccttgcacctgattcccttttcacctattctgtgcggtcagtatagatgcactcaacagttctatggaattatactagatttatagtaccattttctatcagattcgtcaagtttccttttacattttgcatgataactttttaaaatcattattcttcgctgtcattttttccagcatgccaccaaatgtcccggtgtcctttcttctaattccggttcctgctgcctgcacaaatccatcgcatacggacaacgtgtatgaaatcggcatccggatggaacatgaagcggacttggcagttcccctttcattccaaactgttccagactaagtgcccgctttggatccgcaattggaatggctttcagaagtgcctgtgtataaggatgacaaggattatcataaacctcatcgctttctccgctttccacaacctttcccagatacatcacaccgatccgatctgaaatatggcgtaccatagataaatcatgtgccacaaacagataagtcagtcccagttctttctgcaaatcttctaacacattgacaacctgtgcctgaatggatacatctaaagcagaaattggttcatcacaaagcagaaattccggatgaaccgataacgcccttgcaataccaatgcgctgacgctgaccaccggaaaattcatacgcatattttcccatatcgtctgccttcattcctactttttccagcaaacctacaattcgctgttccatctctttttcagaaagcttttcaaaaactgaaatcggctctgccataatttctcttacattctgatgtggatccaatgcggaataaggatcctgaaagataatctgcatccgtttatggtaggaaagaagctcttttccttttatttttgttatatcatctccatcataaattaaagtaccatccgtaggttcgtacatacgaatcagcgttcttcccaatgtggattttccgcatccggattctcccaccagaccaaatgtttcccctctctttatcgaaagactcacacgatctactgcttttacctgctgtatcgttttcccaaaaaaattttttaccggaaagtacttcgacagattctttgcttccaggagatattgttcttttatttccatagttatttctcccctttcttctcttgctcatccagttcttctttcgtaaaaatacatctggatgactgtgtttctgaataggaacgcataaggggaacttcttttttacactcctcacaggcaaatttgcatcgtgttacaaaaggacatccttctggaggatttgccaaagatggtgccatacccggaatcggttccagacgttctcggcagccactttcacatttcggaattgcatgaagcaaagctctggtataaggatgggttggattttcaaaaatttcttctgttgttccttcctccataataagtccaccatacattacttcaatccgctttgccagagaagctaccactcccaaatcatgcgtgatcaaaataatattcatatgttctgtttcatttaactgttttaaaagctgtaaaatctgtgcctgaatcgtcacatcaagggcagtcgttggttcatctgcaatcagaaggcgtggctgacagcacaaagccatagcaatcatgactcgctgtctcattccaccggaaaattcgtgaggatactgctccatacgactttcaggagaagaaattcctacctttgcaagcatatccactgctacttttcttgcctcttttttactcagcttttgatgacgacacaagacctcagtcatatggcttcctatttttttcagtggattcaaagctgtcatagggtcttgaaaaatcatagccatgtcttttccgcgcatcttttctttttctttctctgacatggataataaatccttctttaacacttccagatggtctgcctgtatctctgcattttctccaagcagtcccataacagatttcatcgttacactttttccacttccggattcccctacaattgcaaggatatccccttcatccacataaagagaaacccctcgtactgcctgaattttctgtttatgacttttaaatacagttgtcagattgtcgatggttaatactctattttcattcatcttcttatctcctatttactttcatccatcacacgcggatctacataaatccggagcagattacccagcttgttaaatgcaaatatagtcagcataattaaaagtcccggaataattgccatataaactgcattttgcagattactctgcgcactttgcaataattttccccaggatgacaaaggttcctgaattccaattcccagaaagcttaaagaagattctgtcataattgcatttgaaatacttgtcgttgctgcaataataatagtaggaagtacagatggaatcagatgtctgataaccattttaagtaaggacacacctgtaaaatctgcatataatacatattcccgctcctttacagacattacctctgcccgaacaagtcgtgcaatctccatccaggaaaagaatccaattacaataacaattgataccagtccctgtttaaaaaagatactgacaaccgtaaccaaaatcagccatggaatagattgtaaaacatctacaatacgcatcagaatactatccacgattcctccaagatatcctgccagaatcccaactgtcacaccaatcgtaatactcatcaacatagcaagaacaccaactaataaagaaatacgacctccatagattacacgagccagataatcacgtcccacttcatctgttccaaaaatatgaacactgcttggtgcctcaagcatatgagagacatctgttttatttggctctaacggcagcacgggagccagcaaagataaaatcaaaataattgcaagaaaagcaatcgaaaatattgctattttatcatgctttaatgcctcccagacattttccagacgttttttttgagaatcattcattgccatatacttacctcatctttctaattcttggatctgttacgcaatataagatatcagacaacagatttcccagaacaaccaatgtggaagacaaaatcaggataatcataacgataggataatccattccctgtactgctttaataaagtaaggtccaattcccggccagctaaatacggtttctgtaattactgcacctgttaccagagtaggcagagccataccaagttttgtgataaccggaagcaatacatttttacagacatgtttaaacataatttccgtacgagatgctccaaaagccttttgtaccataacataatcttccgaatactgagtaattgtagaagagcgaacatatcggacattatccggaataaatgccagcgtcagtaccacataaggcataataaaatgtaaaaagaaatctcccagtgtttttacacctaccgtatgcataccaagaatcggaagaattctcaacctgtagccaaacaggtagataaacagcatcgctacccagaatgtaggcatggcaatccataaagaacaaattccatctatcagtttatcctgccatttatttttatgagaacctgccagcaatccaagtacaattgcaatcacataggcggtcagataagaaggaagaaccagtttgattgtgtttggaatccttattgccagttcatcaaagatattggttttcgttacaatagaatagccgaaatttccatttaaaattccctccagccagcgaatatactgcacgtaaaccggctgatcatatccatacttttcacgaatcatctgaaccatctccggagacatcttcggagttgtcatagcatcaattgcatcatagggtgccagatgcattaaagaaaaacaaagaattgtgattacaataatcagaggaatcgcagtaagaatacgttttacaatatactttgccatgttttctcctttttgctttttactcaaaaaaagacggaatccttcactttatttcagaagaattccgccctttgtaaaaataataaatcaatacttacttattttgcaattttcagattggaagtatcctcaaacgtgtacaccggaacaagtcctgcttcttttacaccttgaattctgttgtttacaaccagaatcttattattggaaataattggataaaatgcacctgtgtcttgaatagcagcctgcaattttgcataagtttcttttcttgcagattcatccatctcagaaaatccttcttcaaacagctgatcgattgtatcatatccactgtaatgcatagaattataagcagctccattcttaaacagacttgagaatgtatcagggtcaattcccataatataacctcccagatacatatcatactcattattcggatctttcattgcattagaaacagctgttgcgtctcctcccgcaagttctacctctacaccaacttctttcagctgctcctgaatcagaagtgcctgtgcagactgtaccgggtcactggaactatatccaagtttcaatttcagattacttactcctgcatctttcagcatgctctttgccttatctacatcctgctcatacttctctacaccttcttccgtatagaactgactgtttgtcggcaggaaagtatacggaatgctataatattcatccgactcataagctgcatcatccattgcttttttatccatagcaaacaacagggctttacggacattttcatctgtcactctgttacagttaaactgtaaatatcctatacgaccctcactgtaagaatatgctgtcagattgtttgcatccaaatccagttttttcacctgctgtggtgtcagctgataagcatctacttctccattctgtaaagccaaaatagcagtatctgcattctcaataatctggaatactacatttttaatagcaggttcacctttataatagttttcatttgcctcaaatttcagataagaaccagattgataatctaccagtttatatggaccggttcctactgaattcatgttataatcattatgttcaaagtccgttacatctttatagatgtgttccggcataataaaaatctggctcagcatttccatagcagtaggtgtttcaaatggaaatgtgaaagatacgatatagtcatcctttttttctacttttaccgctccctgatcatataccagctgggaatatgcccaacccagattttcttctttttccatagcctcataggtaaagacaacatcgtctgctgtaaatggttctccatctgaccatttcacatcatctctgagactgaatgtataggttttattatcatccgatacttcacagtcttttgccagaaaccagttgattccatctgcattattcatatacagcggagaataaatcatcttaacagtcgataatccccaacggtcagatgttgtaatcacattaaccgtttctgtcggatctccggaaatcgcataagtaaatgtgtctttaccggaagtttctgtagccgctgtactcttatctgaagctgttttactgtcatcttccgcaaccggatcttttcctccgcaggccatcagacttgcagcaagtacaacagtcagagcaaccacagatgcaagctttgtaattctcttcatcttactctcttcctccttattttctctctttttcagagtcactactcttcattatgctatcagctaaaaacaattttgtcaaacatttcttgtcccaaaaagaaatcaccacatcccggaaatcttacgtggaatgcagtgattttgtcatttttgatttttgattttttctctttttttccgtgtcataatgccaccgattctaccggtttcttttgcagagagactcttccatccatctttcaaaactctgtctaaaagcccgagttcttctgctatctcatatttcactttttcttcgggagtcagactttccaaatcaatctctttttgctttttttgactcattttatactcctttttccttatatgtactctcagaattttgagcgtacaggaattcttattcttttatacaggagtattgcctgaaatttttattttataccgtttctttttattttgggataataattgacgcaataatataagcaataattcctgttcctgcaccaatacagcttaagattacccatgccagacgaaccaacgtcgggtcaatatcaaaatattctgcaattcctccgcagacgcctgctaacatgtaattggttgatgaacgatataatcttttattcgacataataaattcctcctaaattcaaaatcttcctaatttaatatagttcatacagaaatgtaaaaatgaacgttacgattcaaacgttatctgaacatcccccattccacagtcaatgcttaattcctttccggtatcatttttatctaaaaattcatttccaaatccggaggaaagaacgttatctccaatctgaacagtacccattccaacctctgcctctgcactgtagtcctctctttttcctgccattttcatgtccaccgtacctgttccgcaggaaatatcacttacttttgcatctaatttcgccacagatacttcaccggcaccaacctctatctcacattcctgtgctcttaattcatcggatacctgcaaaacccctgcgccaacttccaggtcaagagaagctgcatttaatttgtcgataaccagttgtcctcctccgttcatttcaactgtcactgattcaaactgcatatcctgcgggagaataatctcaatcgggtctttttctccctgatgattctttccttcccgctcaattgaaagttcccggtcttctctgtcatattctacaacatctgcgctattataactctttaccttaattgaacttgcatttgcatccgtcttaaattccagataaatggcatttttttcttctgtttcaatacttaatgaactcacttcctctttgctaaattcatattcctgttttgcttcagtatctaatttcgcatagattgtttcaagcccatcagaatcaaatccttttccgtctgcaagtacattcactttttctgcccagccaaaatattgcatccctttatcctttagaacagaccagtccggaccaattatcattccggctaaaaacaatcctgctccaatcaccccaatcacagctgacaaaatcagacatgtctttgtaaacattttcatacacgctgccctccttttcttcccttgtaaaagattctctgaagaaaatcaacgcatcctcgaaagactatcggaaatccttttccaactatccagagaaagactaacaggattaaaattgcaatcgcaactgctaccataccgcccccggctacaattaaaaagattcccggggatgaaatcaaacgaatgatagctaaaacaattgcagtaattcctgcaatcaaaagtgcgacacctccaatgccaattgctgcaatgattcccagcactcctacaatcaaaccaaataaaacacctaaaatcccaagtcctccgccagcccagattggagaagttaaaataacaagcactatcacaagtccccaggtaagaccgcttcgttttttctgtgtatgctgtccatatctgctttcttcctgatgataatgatttgtttctttgagcatatctttcttatcaaaacgcacatcctgataaccctgttccgtatactcttcatagtctgcttcatttccggaaaggtctgctttgataatcgcagccaccttcccggggcttcccagctcctgaatcacctctgcttctttctcttttccggcatcatcaaagtatccattataatattccaatgcctcttcccgctcctgcgcaggaatgtcatacaaaagtcgttccagctggcttaaaaattcctctcggttcatactcacaacacctctccctcaaataatccgctaatctttcccgaatatgttttccattcttctttatacaaattcaattgtgccattcccttttctgttaccttataatacctgcggtttctgcctccaaattcctggtcataagtttccagacaatcatcttttaaaagccttcgcaaaaccggatacaacgtagattctgaaatctcaagcacctgccgtacatcctgcgtaatcttatacccatacgttccctcggcttcctttgagacaacagcaagtacaattgcatcaagtaatgctgcacctgtattaaaaaccatgtatgctttcacctctttttttgtagagttatttcttatacaatactatacgtcatataatatagttttgtcaataatattatattaaataaatcttaaggttttataaaacaaaaaaatggaaggttttttatttttctaaaaaaccttccattttctttacgctactttctttactctaccgcaaatgcccgctccaaatttacagaataaatatatttttcttccaccggcttttccaacatccgctccagtgctttctgatagtatttcagctgaattccatactttccaaccaagtcactgccatcccgctgttctacataatctgtcttgtaatccaacaaaacaatttttccattttcttcaaaaaatgcatcgatgattccctgtaccagcatcgtctcttctcccgtctctgtttttaagatatctgaagccaaaacttcaatgacaaagggctgttcacggaataaacatccctcgctttgcgcctgtttcattcgttttccaattctcgaattagccagtgcaaaaatcttttcaggttttactgttacataaaccgattcatctattttttgttcttctctaagttttgcaagctgattttttactgccgttttggtatccgtatctgtaaaatccagccactgcagtaccttatgatacgcatttccgcggtctaccccgactaaaacctcgccttcttcctgcataaatgccggaatatatggttcaatttccggcaattcttttatttcttccttctcgtctgcaagaagttcttctccaagaatctgatccataagggaaactctttcctcaaaggaaatgctctcttcaaaggaaacactttcttcatcttcaaactgcatccgtttgacttctgaaactgttaccttagccggaacttcggcttctttctgccacggatattcccacaaaaaatgttcctgtatttcttttcttattcgttcatctgaagatgcacgctccatttctgcaatcaattcctgctctttgattaactgctcacttcgctcttttgcctcacttaaaacaaactcaaccggtgattttacagcaatcaaaaatggagctgtttcttcatgcaatgaatgactcacagggcaggaatattcatactgctgatacaatccatccatacagcggtgtcttgcaagtgccggaaaaatccagtccagatacattctcgctttcacaagttttccataagacagacgcattttttcttcattttttatcagttcaagtccttccacacgtttctccagtctgctgactgccccagtcagatataacttttcttttgctctggtcaaagctacataaagcactcgcagttcttctcccagattttcaagctgaatctggcgctgaacagctttctttaataaagtcggtgcttttgttctgcgttttgtatcaatccagtctgcaccgattcccaaatccggatgaatcacaagtgacgctctggcatcctgctgattaaacaattttccaagcccggatacaaaaacaatcggaaattccagacctttgcttttatgaatactcataatctttacggtattttcctgacttgccgtgatgtctgcttcaccaaaatcaatctggtatttctgcaggttttcaatataacgcacaaagttaaacagtcctcgatagcttgttttttcataatctcttgccttctcaaaaagcatctcaagatttgcttttttctgttcgccaagcgcatttgccatataatattctatcagtccaaggctctcataaatatcccataacagctcatggattggtgtataggcaaccttcacacgcagggtgtaaaactgttctagaaatcggctgatttttctttgaatttctgccgctccgtctgttttctcatataacaacatacattcaaagaatttaagcgtctcatctgaactttcttttcccgcacattttatctttgccagttcttccattgtaaaggcatccggcagatttaaaagcactccggcaaatggaatatcctgaagcggattatccagaatccgaaggtaatttaaaacagttacgacttcctgtgccgagaaatatccggtctttgtcgttacgcttgcaggaattccacgactctcaagaatctttttaaaattttctgcccaaccattcatggtgcgcagcaaaatcacaatatctccatactctgcttttctataaccgccattttctttatctacaaccggaaactttccaacgatttcctgaattttatccgccacaagtcttgcttcaagttcctgcacattttcttcggtttccatctgcttccattcggcttcatcgctttccaccagcaaaagttctgtttctcttaacaccggctcactattttcctcaaacaccgctccggcatagagtgccgcatcttcatcatattccactccgcccagactctctcccattatctggtaaaagataaagttgattcctgctaaaacttcctctctgcttcggaaatttttatgcaggtcaatccgcaccttatctccggctttctgcaaatatgaatgatatttttccataaataaatccggtcttgcaaggcggaaacgataaatactctgcttgacatctcctaccataaagatgttattctgtccctcttccatccttgataccgcagttagtaatttttcctgtaccagattgctgtcctgatattcatcaattaaaatctcataaaaatgggcagaaagttccttcgctgcctcacttcgctcatccccattttccgtatgatgaatcaaaatttccagtgcaaaatgctccaaatccgaataatccagcagattcttttcccgttttttctctgcaaatgcttccgaaaaacgaagcgtcaaatcaattaaaaccccaaccggtcctccggcttcctgcagatatttagctgctgtttcaaacggcacaccaaagtactgttctttgatttcatttaaaccgtctttgatttgatttcgataattttttaccagttcttttttattttccgatgcttccggcattttttttcccgataatcttgcataagaaagatgggaaaaaacctcctgctgtgcttcgaaactgtctgcttttaacagcagttccactgtttttaaatcctgacttaaggcttcttcgtaaagatatggtccatcttcctgccgacaaagtgcaattcctgcttctgcaagcatacggatttcttccagatttttttcgatatcggactttaacaactgcatccacggtgcctgctccacttcttttactgacgaaatctgatatgcatctttgcaggataccagccattcttttggatacggataactcgtcgaaaaagtatacaatttacgtatcaattccaccaacccatcatcagaacgccctgtggaaaacgcctccacaaactcatgaaattcttcactgccctcttcataagcctcgctcaaaatccgctcggccacatctccctgaagcatacgcagttccccttcttctcccacacgaaaagacgggtctaagtcaattaaatgaaaataatttcgcacaatatacgcacaaaaactgtcaatcgttgtaatcagcgcatgatgaagcagggtattctgctttcttagatgctctaacatctgctcttttttcggactgtcttcctgcttctcttcttcctcgattcgagcttctatcgcaagtcggattcgctctctcatctctcctgctgctgctcttgtaaaggtcacaattaaaagctcatcaatcgaaaccggatgctccaaatctgtaatcatcgaaaggattcttgccacaagcaccgctgtctttccacttcccgctgccgcactgactaatacatttgcatttctcgtctctatgactttctgctgttccggggtccatttcatttccatttatttcttttcccccttttcattttctgctttttcgctctcctgcatctgctcttccatgcctttccagatttcctcactttttacctgcgccagtctgcggtatccacacccttcttttttctcatcaaacccacacgcaccttgatatgggcaatactgacaggcatttctttgtcccatctcataaggtgaaaccgacgcttctccctttaaaatacgctgtccgatttcctgtatcttatgtttgacatagcctgaaaccagttcaaaatgttcctcatctaccgcactggaagtcttagaaagtcctccgcttttattgatagaaactggaatactgtttgaagatacccctttttcttcgagtcccttgtccagacgttttaaaatctccgggtcggcagatgccagtccattcattctaagctgctttaacagtctctgatttaaagactcttccgattccttttctacacaatctacaatcgggtctttgatattataataaaaaatccctgccggaagtacgtttttatccggatgagctctttgttccagttccattgccgcatttaaatacagcaccagctgaagctgaagtccgtgatacagtgccactaaatcaaacgcagtacttcctgatttatagtcaatgacttttacatagacattttcagaatcttcacacacatccacacggtcgattcttccctttaatttcattgtctcctcttctgaaagcgcaatattaacgctttctaacgaatctgccattgcaaaggaaacctcaaaccggctcggtttaaattcgccctgttccatctgttttgcaagtgcccaaaccgttcttcgcatcattcgtttgacacgattgaccatataagcatttctcgcatcactttgaagcacggtattcccataggaatcaacggcttcttccacacaggaatctgcgagtttttccatctcttcgagactgatttcatcccattccacaccctgttctttgatgtgtcttgcaaaacgttccaatccagaatgaagcacatttcccatatccattgcattaaattcataggccgtacgttcttttaattccagcccgtaagagaggaaatgtgcacaggcacactttgcaaaaagttccagtctggtcgcactgttttccagtatctgtccatacagtgcctttgccacacttcttccgatattatcagcgattttctttggaaatgcactcttcatcagaccttttactctctcctgccattcttcctgtgaaacaaaccacaaaaataattcctgccagtatttagacggtgtctcttttcggatattctgaaaacctttggcaagatatgcaaatgcctgctccgtcttttcaaatgcaaaactgtcattttgtctaactttttccaccggcaaatccgcaaacatctttcttaaatttccaatcaaaaaggaaggaagtattgcctctccatctgccccctgcttgctgtaagagaggaataactgatttgatggcttcgtcagattcaaatacagataaaatttctgtgtatacagattttctttcgcagttggcgcaagcgctacttcagacaatttcaaatcttcacggtttaattctgataaaatttttccaccaccatcttctcttggaatttttccatcattgactccgacaaaaaacaaaacctgaatgtcttttaaacgggttcgctccatatctccgaccagcacctgatctgtacttggaggaataattcccacctttgcctcagaaagccctgcctctaagagttctttaaactcccttaaactgacactttcttcccccaaaacctgcaccattttatcaaataaatccatcacaatggcataaatctgactgtattcttttgcctttccaacctctccgtgtgcctcaaaatactgctcacttttctttaatttctgctgaattctgcatgaaacaataaactcataaaaggctcgcacacgctccgataccgtagcttttcgcactttcatacgcaaagtaaatccttccaaaagctccatcagacgaactcttaaagcttcaatttttacaacttcctctggattttctccccgataagctaatgtccactccttctgccacttcttccagctcttaatacccattccaagcatatagttttctaagacgtccatttcttcttccgtcaaatccaaaagcccgcatcgaagaaaacgaaacacactctcatagctataattttctatcagcatatcaatgcaggcacgcagaaattcaataaacggattcataagcacagtctgtttttcatcaataaaacacggaatttcgtaacgttccagcatcttctttgcataatctgcgtaagtatccatgtctgccgtaatcactgcaaaatcacgccaacgcatcttcttttgacgtaccatccggtgtatcattccggaaacatattccatttcttctttgggattggcacattccaaaacccttatcgaatcctgtctttcggtataacagtttcttttagaacgaaataaattctgctctaaaaatgccagtgccggctgatggaaaaaccttgcgtttcccttaattttcacatcgtccaccggacagccgactcttgacgctgtctggcacaatctactcaccgtctgcttacttaaataaaacagattcgtcgcatcactctgcacataaggacgttccccttccccgattgtaaccgtcacatacatttcttcgcagaggggcagaatcttctccagtacattttgctgaatcggtgtaaatccggtatagccatccagaaccagtatgctctcttttaattttttcgactttccggctacacttccaagcacttcaagcacttcttctcttgtgattgcttttccttccagatactcaaaaaagccgtcataaagcactgcaatatcctttaatttatagtaaagttccggcttatcctttgcacactccagcattttttccatgtcttcttttgagacttcatactgccgaagctcagataccatggatttcatttcagagatataaccctgtcgtttcattttttcgccaagcacacttaattccttcttatgattttgtgccacttttcggataaccagactctttccggtctcttctaacacatcctcacacagataacctgtttcttctaatactcgaaaagcaagacgttcaaaacttaagacatcaatatttaaaattccttttcttggatgcatccggaccagttctttctgtgtctgcatcgtaaactgctctggtactaataccagatattgcttcttcggattctgaatggattcccgtataattttctgataaatataataagattttccggcacccgatgcgccaaacacaaaatgtaacgacatgcgtttcccctttcttacaactaactgtttctgtcttttactttaggaaaaatttttcaatgacctctgcaattccatcctcatcattactatttatggtaatataatctgccacatcttttactttttcctgtgcatttgccatagccaccccaagacccgcatactgaatcatggaaatatcgttaaatccgtctccacagcacaccatctcttccctttcgattccgagaatctttaacagacgttccagacaatatgccttatccacatttttcggaagcacctccaggaaatatggttccgaacggaatacctgcgcttctaactgatatttctcggcaatgactggttcaatactctctaataattcaccgtcagccgttaaaatacacttgttaaccggaaaattgacataagatttaaaatccggttttttaatcacaggaagtgtcgtaattctggattctatcataatatattcatccggtatttttgcagaaataatagaatccccctcataagtcataagacccgttccataatgcatggcatcgtcatataatttctttggaatcccaatcggaagttctttcgagtaaatacattcttttgttttccagttaataattcttgctccgttaaatgcgagcacataacttccatactcagcaaaatccagttcatctgcaactgccacaattccctttgtcggacgacccgatgcaatcgctaccggaatcccttttttttgaagttctaaaattgcttcttttgtcttttgggtaatctctttcttagaatttgtcactgttccatcaatatccaatactaataatttataactcatttttaaaaaatcctcctcaatttctcagatgtttaaccaaatcaagtaagtcccctgcttcaattgcgaaaagcaataagcaggggtggggacttgcttgtatcaggagggggcaatccccttctgataagctgcgtagcagctatttggttatgagcaagtagcgaagcggattgcgaatatccacttgactctgaaaccagtttaacacaaaaagttttctcaaccaacctcgttgggggcatatttttctttttctcctaataaactatgatgtgagtgtcaaaaataaattttgccactcgctgatgtatccggattgcttcattgctacgcaattctcacaatcctcgaacacctcaaactctcataaaatggcatattcataccattttattacgttttcgttgttcggcgtgtcaattaaatataaattgctttttatgcaagcacaaccgcaatttatatttttgacacttacatcaagttataaaaaggaataccaggagggaatactatgagtgcgaaaaccaaaattgttgtactacatacgaaagaagtgatttataccgtgctttttgttgtactcgccattgtgcttgcagtccttctttttttgatgttcggaaaagacaaaaagaccacttctttctcaggctctcccgccaaatatcacgccggtatctataaaagcccaattacgctcgataacaacacctttgatgtcgaagtcacggttgatgaacatgaaatcacctctatctccatgacaaacttaagcgaagcaacaactgctatgtatccactgatggaaccggcactcgaatcccttgcgaatcagatttatgcaacccagtccacaaaagaccttacttatgccgaagaaaataaatatacttcgatgctgttgttagatgcaattaactcggcacttgataaagcaagggcagattaagaagatctacaaaaaatggctccgaacaaaagtccgaagccatttttgctgcctactatgtacttattatttaattgcaccttctaccataccctgaataatctgtttctgtgcaaacaggaacaagataataatcggaatcatggcaagcagagctgctgtcaggattaaatcccattgttttacataagaacctacaaaactgcttactgcaaccggaagagttttgattcttccgtttaatccaagcatcagagatggaagcaggtaatcgttccaaatccagataccatttaagattaatactgtaacctgaattggttttaacagcgggaagataattcgaaagaatgtaccctcaggactgcatccatcaatccatgcagcttcttccaactcatacggaattccttttacaaaaccatgaaggatgaatacagacattgaaccaccgaatccaagataagcaaaaataattcctttgtaactttgaagcatctgaattcccaaaaactctgaagtttcacggaaagtagataacagtggaagcattacaacctggaatggaataaccattgctgatacaaataacataaaaatgaaattagaccattttgttttatttcttactaaaacccaggctgccatactggaaaacagagtcagtaaaatcagagatactgctgtaatcaacagggaactaaagaaagaaccccaataattaaagttatcattatggataacattgctcatgttggtcaacagctgtccccagttttttggtaaagaaatcgggctgatgacaatacttgcactatcctttgcagagttgattataaccagtaagaatggagctaacatcacaattgtcagaagaattcctacaatctcagcgattgttgttcttattttctgtgctttcattacatttcaacctccttctttttactgattgtaacctgtgtcagagacacaattgcaagaataataaagaatataaccgctttggtctgaccaagtgcatactggttctttccaatcgctgtattataaatattcaatgctaaaaattctgtagactgtaccggttttccggaaagaatacgagtcggtgcaccattggtaatagcaaggttcaaatcaaactgtttaaatgagttaaccaaagtcaggaaaatacaaattgtgaatgtatttgcaatcatcggtactttgattttcagcagagtctgaagtgtatttgcaccatctacattggatgcttccagaatatcttttggcacactctgtaaaccggttacataaatcatcatgatatatcccgcatactgccaggtacttacaattaaaattgccacaagcgcaaggttcgggtttgtcagcatggaaacacttcctgaaattacagaaaccgcaactttattgaaaatgaactgccatacataaccaagtacaattccaccaatcaggttcggaatgaaatatgctgcacgatagaagttacgaccttttacttttgaagtacaaagcagtgccagtgcaaatgctacaatatttacactcagcatattaattactgtgtaaataaaagtcacaacaaaagaatatacataatccttagacttgaacattgcaatgtagtttccaaatccaacaaaattatcatattttattccgttccagtctgtcaaggagtaaaagataccacaggcaaacggaataagcacagttactgcaaatgcaaacagcagtggaaataaaaataatacataaataattgaacggtgtttcttcgttggcagcaggtaaagccctacaataagcaataccgctcctgcgattaaaagtcctccccgaaaggaagttcctgttctcataaaatccatgtacagtgccgctgccattgctatgattccagccacaattgctgcacatgatattgcttttttcgactgattcattcctaactctcccatcaaatatttaccggctgtcttataacaaagacagccgataaaacctattatttacttgatgctacataatctgctattgaagaagccattgtacttacaaatccctctttatcaagctgaccttttgcatacagctcaaatacaggaccagttgcattcatagccatgttatccggctgtgttacccaatcccatgcataagtttttccagattcaatataaggaagcatactctgtgcaagtggtgtagaaggttttaatgtacaagatttaaatgtagaaaccataccgcagttttctacaagtgctttctgaccttcttcggattcagcaagtgcttttaagaattctttacaagcatcaattttatcactcttattgtaaattccccataaacttggtgtatcaacgataagaccgtctgtatcttcttttgtaaatgctgatggagcaagtccacatgcaaatgttgcatcataagttggtaaagatgggtcaatccagttaccctgtgtgataaatgctgcttttccggttgcccacagagccagctgatcatcataagtaccggaaatcaatacattctggtctgagtaatcaaataataactgtaaccagtctgcgaactgtcccattctatcttcatcaatttttccttcattgtttaccatatcaatatatgttttatcatcacggtcaactccctgtgaataataagctgctaataagtggttaccggttgaccagtacatctgtccggattctgctgcaactgcacaaacagatgtcagtccaagttcatctttcataccgtcaattttttcaaatgctgctttataagcatcaatgtttgtcagagtagaaggatcaattcctgctttatctaagatatctttgttatatgcaagaccaattccttccagtgagaatggcataccatatacttttccgtcatctcccttaaatgcgtaatcagtatcttcaatccagtcttctccgtcaagtggttctaaccagtcactgaaagaagatttataagagtcaggaccaaatgcaaagatatctggcatgtttcctgctgcgtagtagtttttcagctgaccatttacgtcaacaccgccacctaaagattcgattacaacttcctgtccggtttcttcttcatactgttttgcaaaatcttttaaggccgagtcaatttcaatttttgtatttacaaaacggattgcatctttattggcactgcttgaagctgcgctggaatcactggagctgtctgaagaactgcttcctgaactgcttccacatgcacctaatgtcattgtcatcgttcctgcaagtaaaactgctaaccatttctttttcatctcttttaccaacctttcttggaattttcatcttttttctttatcacttatgcgcataagttcttgatgaaattatcatagcacccctttcgttaaaaagcaatactttttatatgccattctatacatttctacattttcaccagtattactacttattttcatggtattgcaacctattttttgtatattttgcagtaataggtttttcgcaaaaccttttttcgttcatttttcgtttatcttatgcgcaaaagtaattccatttttcgacttttttcattttgcgcataagtattttgaagtcaaaaaatgacattctgctttcggcaaaatgtcatttttctgtctcttattttctatattcttaaattttttttacagaatcccgaattacaagttctgttccaagctgaacaattttatcttcggattctccctctatcagttttaatagttcctctactgctgcaattccttttgcctgaatgtcctgtcggactgtcgtaagcgccggacgcaccattcttgaaattggaacatcatcaaatcctgcgatggaaatctcttccggaatttttctttctctatccaaaagcatattttcaatgtgtaccgcataataatccgaagcacacagaagagccgtatacgaaaatgatttctcataaatctcatccatattttgaggctctcctgcatcgctggcataaatttgaataaaattttcttccctacttaccggaatgttcgcttcttttagcgccctgcaaaatccctgaaatcttattttatccagatttaccaagttatcagcaaggaaagcaagctttctgtgaccacacgaaataacgtattttgtcagcaaatattccgcctgttcatcctcgatcctgatattgacacagtttcccagaccatttgtatcataatcatcaataatcgcaatcggatttttaaggcgctcttttaaataacggatatcaccctctacaaatcctgaagtaatcagcccgtccatgttccaggacatcgtaaactgctgaacctgatgcacatcgtcgactgcatataccatcaggtaatatcctttttgccgtacatgcctttcaatcgcacctaaaattctaccaataaatgggtcttcaaatcggttcgctatcttattctgttttgatttaatcaacaagccaataatctttgatcgtttactcgcaaggtttcttgcattgatatttggtgtatagtcatatttttttaaaattttctgaattcgttcgatattagccagtgaaacttcttttgtcttgccatgaataacattcgaaacagtcgttgtgctgactccgagctcctgcgccatttctttaattgtaaccattctttactcctgtttttacactgctcttctgactgctcccacaggcagacctatggattttcgccataatttatagcagttttacttctatttttttctcacgacttccagtatacacacaatttccacctttctcaatagtgattctgccataattgtccggattctcataatcttttcccattccatcatcttcataccacacatattcggcttttgtctttacaaatgccagtgctttgacatggtcacagtctacttcatctgcatactcgccaccatctgtcagtaccaaaattttatccggacgtacgaaaactaacatttcaaacaagcctgcttctacatagtgatgtcctgccgggagaatttccgtatcgtaatcatccacgcctctaaagcgaagcattgccatttcctccggaagatagacatatctgccttttgcattctggttataaaccggagcaatcattaaactgtctccaaccaaaagctggtcttctacctgagaagcaaattcatcatctgtatatacaaaagataatggtttgaagtacatttcactgtttaaggcagatttcatatactcgctgtaaatataagccagcagaccatagcgaatattaatgatttttctaaattcttctacatggtcaaaacgatatacttcctgttctcttgttcccattgcactgtgatttctcatcagtggagagaacatggcaagctgggtccatctcatgaccaaatcttccgttgcatctgcaccaaatccaccgatatctgcaccggtataaagaattccaaccatgtttaaggacggcatcatacgcagattcaacaacagatgattccaccaggatttattatctccagtccagattccaccataacggtgcatgccaatataagaagaacgagagaacattaaaattcgtttttccgggctcaggcgttcaaatgcctctcctgccgcacgggtcatattataaccaaacaaattatgtactttatcgtggcgcatcatttttccatctacgttatgatagaacttcttaaagtcatctgtattgtttgccagacttccaaccagaccggtaaactgctggaacgtatccagatcaaggtttttatctttcaattctgcaatcttatcaaaggtttcatccattctatcctgtgcaaagaaaatagacggctcattcatatcattccagaatccttcaattccctggtctaacagcacctgatatttatttccaaaccactctctcgcctctttgtttaatacatccgggaaatgcacttttccgggccatactccggctacaaagtattctccattttctttcttacagaaatagcctttttcaatgccttcttcatatacgtcatagccttcttcaacttttacacctgcatcaataatcggcactaaatgaatgtgctgtgctttcatctcttttacaaactcaggaaaatccggaaaacgttcctgatttaccgtaaagtctttaaaccgctccatgtaatcaatatccatgtaaatactttcaagcggaattttcttttctctgtgtccttttactacttcacggatatcagcttcattcatataaccccagcgactctgctgatagccaaatgcccacttcggaggaatatagcttcttccaatcagctgacgaaactgttttacaatgtctaaaatgctttctcctgtcattacataaacatctgcatccggttcacttaatgtaatttttaattcatttaaatgcgtatatcccacatcaaatgtaatgattcccggataatcaaaaaacacaccaaattgctcttttcctccatctaaaactaagaagttatgagatgcatataaagaggtacggtcctctaaatggttcggttcatctgcgcagcagctcttataaatccagcctctcttgttaattccacgtacattttcacccagaccatacaccttttcttcgttttccagtgtatactcaaactgaagctgttcctccgtttttgccactgtaaaatacggaacatccccgttctgtacctctaatttttgtaccactgcatcggtctgaaatggatttccataagtgtattttgttatcatgtcttaacttcctcctttattttttatgtactctcggactctttctgcctttacacatattagcccattttcagttccattttttgtatcatagcatggcattttatttctatcaatcccttttgcgcataatccacatgtgatacaataatttttccagtatttcggcagtttttcagtttattttccgcaatttcagtcaaatatgccaaaaaactgccggtgttgtccgacagtttttttgatttttattttctataatgtttccaactcttcaatccagattcgaacacaggcatcacttggcattcttaaatctcctcttggagaaactgccacacttccgaccttcggtccatccggaagacaggaacgtttaaactgctgagagaaaaatctccaataaaattttttcagccattttaaaatcacttcttcttcgtattttccttcaaaggctttttttgcaattcggtaaatttttttcgggctgcactggaaacgaagtaaatgatacaagaagaaatcatgcagttcataaggtcctaccaaatcttctgttttctgggaaatcaccccatcttttggaggaagaagttccgggctgaccggagtatctaaaatatccagcaaaatatcagaaagtgcttcttcgtcgcaggtgtctgcataatatcttacaagatggcgcaccagtgttttcggcacagaagcattgacgccatacatggacatatggtctccattataagttgcccagccaagcgcaagttcggacaaatcaccggtaccgattaccattccgccaaatttattagcaatgtccatgatcacctgagtacgctctcttgcctgtccgttttcgtaagtaacactgtggtcagacgggtcatgtccaatatcttcaaaatgctgagtcactgcttttttaatatctacttcttttaaggttgccccaagacgttttgtcaactcacaggcatttgtgtaagtacggtccgttgttccaaaacatggcatagtgactgctaaaatctgttttctgtcaagtccgcataaatcaaaggctcttgccgtaaccaaaagtgcaagtgtagaatcaagtccaccggaaattccaagcacggcgcactgactctttgtgtgttccagacgttttttgagtcccattgcctgaattgtcagaatttcatcacatcttctgtctctttccccttttgcatccggcacaaatggatttgcatcgataaaacgttccagttttgtctcggttacatttaaatgaaatggaatcacctgataattttcttttccctctgactgccaggttgtattttttctgcgctctccgactaaacgactcatatctaacacactgtaaatcgtttcatttgcgaagcgttttgcttcttttaaaatcgtaccattttctgcaattatattatgtccgctgaatactacatcctgcgtggattctccatttcctgcggaggcataaatataaccacaaagcagtcttgcagactgaccggaaaccagatttcttctgtactcatcttttccggtcgcctcatcactcgcagacggattgataatcaaagtagcaccagaaagggcatgagaaatacttggcggattcggtgcccacaaatcttcacagacttctactgctgttacaagctgtggcagttcttcacagacaaataagagattttgtccaaaaggtacttctcttccgtaccagtttaccattccctcaaatgcacggcctgctgtaaaatgacgtgcctcataaaactctgcataattcggcaaatggtgttttggcacaaatcctaaaacttttccacccgaaattacagctgctgtattatacagcttctggttaaattccagcggaagccccacaataatcaagccttccacttcttctaactcttcttcaagtttgtgaagttcttccttcgcacgcacaagaagcagttcctgccagaacaagtctgaacaggtatatcccgtaatacaaagctccggaaatgccatcacctttgttcctgcttctgccatttcttttactttttttacaatctcttcccgattgtgcacgcaatctgccactaaaatatccggcgttgcagctcccacttttacaaaaccgtctctcatctcgtacccgacctttccttatgctcttgtacagcgttttaaaatacttttcagttcgtctactgtaaagatataatttttattacagaaatgacaatttaactcaatttcttttccatcatcaatcatttctttgatttcttttttaccaacactgattaacgctttttccacacgttctttactacaattgcaatggaactgtgtcggcactgtctccatgatttccacatcgaatccatctaaaatcaattttaataaactttccggtgtatgtccttcctctaacagactggtaacagaagttactttctttaagttttcttctaatttgttaatcacttcgtcatctgtaaatggcattaactgaatgataaatcctcctgcctgttttacggtattgtctttttccatcagcactccaagacctacagaggacggaacctgctcacttgttgcaaaataataagtcaaatcttccgcaatctcactggtctgtaaaacagtctgtcccacataaggctctttcatccccatatctttgatgacgttcataaatcctacgccaaccgcaccggcaacatctaattttcccttgtcattagcatgtaaaataacatttggatttccaacataaccttttacatttcctttggagtctgcagttactgtgattccctcaagtggtcctcctgctttaatctgaagagttaaaatatctttttcccccttcatcatcacacccatcatgcttcctgcagtaagaagacgtcctaatgccgctgttgccaccggacttgtattatgtgctgctctggctgtctcaactaattcttttgtggttgccgcaaacgcacgaatctgattatttgcggcagttgctcttacaatgtaatctcccatttatttccaatctcctaatttttcttttttccatgttctcttgcaatcacataaatccgttcacttttttcattcaccggatttttcgtaaatgcatcataagccgtaacaaattccattccggctttttctaacaattcttttaccagctccaactcataagctcgctgataatgaacttcttcatattttcgataaagaccatccttgccctccggaataaacaatgccaaatcatattcattaatttgttcttcttcatcataataattatcccagataaagctggcatcctcgcgattctccgcaatcgtctgttctccaaggattttttcatacttatagacggtatttaagtcaaaaataaaaacaccctccgggtcaagataattgtttaccagtttaaatacttccagcaaatcctcatcctcggtaatataattcatgctgtcacaaattgagacgatcgcttttactgttccatacaattcaaactcccgcatatcctgacaaagataaaggatatcctgaccttcttcctctttcttttccagtgcaatttccagcatatccggtgcattatccacaccaatcatatcgtatccggcatcggagagcagtctggtcgcatttcctgttccacagcccaattccagtaccagtccgtcatctacttcatattcttttaaaagcccagtcaggtagttacaccactccttgtagggtatgttatccatgaacatatcatacacccgggcaaaactttcataagcgctcaaaaatcattcctcctgtgcacatattcttttttatcttaacataaatcaggtttgcggtcaaaaaaaatcgactgtacccttaagcacagccgactaatgatttatgccctctcagaatctttgtatacacgtatcataaagactccaaacgttcattttatttttttataaacctgttttttctgcaatgaattttcttgctttgattgcatattctaaaggatttgcctttgcaggatcctgttctgcttctactaacatatatccttcataacctgcatcttcaagcactttgaaaatcgggtcaaaatcaatacatccatcgcccggtacagtaaatgttccaagacgtacaccctctaagaagcttaagttttcattttttactttttctactacttccggacggatatcttttaaatgtacatgtttgattctgctgacatatttttttaccatttcaagcggatctgctccacagtaagtaaaatgtccggtatcaaataataagctgacatattccgggtctgtattttccatcatacgctctacttcatccggattctgtacaacagttcccatgtgatgatggaaagtaagagaaattccgtattcctcttttgcgatctttccaagtttgttcattcctgtacagaatgtatcccactcttcatcattcattacatatttatgtccaaaaatcggagtgtcctgcattccctgcacactgtgactctgttcagaagctccaataatctttgcacccattgcctttaaaaaagtcagctgtgcacgaaattctttttctacttcttcaaatggttttgtgattaaaaaagaagaaaaccactgattacagatctccacgccacgaagttccaatgcttttttcagaacttccgggtcttttggatatttatttcctacttcagaaccggtaaatcctgcgagtgccatttcactgacacactgttcaaatgtattttcttttcctaaatccggaaggtcgtcattcgtccatgcaattggtgcaattccaagttttactttttctttattaaacattttttctatctcctgctgttctttttagtcaagtggatattcgcaatccgcttcgctacttgctcataaccaaatagctgctacgcagcttatcagaaggggcttgccccctcctgatacaagcaagtccccacccctgcttattgcttttcgcaattgaagcaggggacttacttgatttggttaaaaaaataccacgaaagtctctacataatttcagaaattttaaccggtctgtgttcttctaaagatttcttagctgccagtcccattaataccggttttaatccatccattacgttaagaggagtttctttatcattttcaattgcatcgataaatgctgcaatttcttttccataagcatccatgtatctctctaagaagaagaacaatggtttttcacctgttacaccatctgcgttgctgataactgcggaagactgactgtcatttttcatagaaaccataccttctgaaccaaatacttctgctctctggtcatatccgtaaactgcttttctacagttatcgataacagcgattgctccgttttccatctgaagtgtaataacagcggtatctacatctccggcttctccgattgccgggtctactaagtttgcaccctgaacataaacttctgttgcatcgcatccagctaagaaacgaaccatatcaaaatcatgaattgtcatatcaaggaacattcctccggatacttttacataatcaatgcttggtggctcagggtcgcgggatgtaatcttgataatctccggtttaccaacctttcctgctgcaactgcctgctgaaccgcttcaaagttatggtcaaatcttctattaaatccaacctggtattttacgtttgttccttttaaggcatcgattacttcctggatttttgcaatatcatggtcaattggtttttcacagaaaacatgttttccggctttgattgcctctaaggaaatcggggaatgggtgtctgttgaagaacagattaaaactgcattgatttccgggtcattgatgatttctttgtaatcttttgttgtgtgttctacacccatgctctttgcccattctgctgtttcatcatttaaaaatgggtctgcaactgttttaatcactgcatcttttactcttgttgaaatacttgtgatgtggactcttccgattcttcctgctccgataatacctacttttaccattttttcattctcctttttatgaattttattgtttttgttttctcttgcgtgcccgagcactttctctttatgttgttataataccattgcgtgcccgaaaacgcaactcggaattttgtacaattttaccaaaacaattctatctaaaattaccaaaagcaggaactcggcttctgcatctgattcgccgatagactggcaatatagcagaaaatagtcaagtggatatttgcaatccgcttctctacttgctcataaccaaatagctgctacgcagcttatcagaaggggcttgccccctcctgatacaagtaagtcccctgcttattgcttttcgcaattgaagcagggaacttacttgatttggttaaaaacaaaaaatgagaaaaattacagaacatgacaattttgtaatctttctcaaaatataatcagccgatattattattttcaattctaagcatacgatatccaatgccaatatgtgtctggatatattccactccatttttctcaggctcaagttttttccgcaaggttgccataaaaaccctgagagaagcaatatcgttatctgaacatcgtccccaaatttgctgagtaatatacatgtgggtcaacacctttcccacgttacgtgacaagatgcaaagcagcttatactctataggtgtcagatgtagttcctctcccttcagatatgtacagcctgccataaaatctatctttaactctccattttcaaaaatagatgttttgttctgttcatctgtctgtgttatcgtaagtcttctctgtgtaacacggatacgtgcaagtaattcctctactgaaaatggttttgtaatataatcatctgctccggcatccagcgcctctattttgtctgtatcttcacttctggcactgatcacaataatcggcatgttcgaccaggtacggatttttcttatcacttctactccttctatatcgggaagacctaaatccagaagaacaatatccggattatgggacgaagcctccaaaatcgccgaagagccgttttccgcaaccaaatatttataatcatgtgtttttaatgtagtaacaatcaaattacgtatgggtttgtcatcctcaaccaccagaattaatgttttattcatttaatgtcacctcgcttaatggtaaagtaaaaataaaattgcatccatgaggagcatgatccgtcagaaccagagttccattatgttcttctatgatagaacgacaaagtgccagaccaagtcccagacttcgatgactatccgcaattgttgtttttcctgtatagaacatctcaaaaatatgcggcttcatttcatccgggattcccggaccgttatcttccacacttatctgtgctttcccatctgctttgattccacgaatacagataatagaacccggtggtgtatattttattgcattatcaattaagtttaccaaaacctgtataataagacgtacatccatacgtgcaagaacaagctcttcacagtctgtcactattttatactcatcatgcttcttgttaatatgccgcagagactctgcaatcacttcatctaaaagctgatctgtaaatttaattttcagtcttccgtcattcagtctggtaatagaaagcaaattctccacaactccgatcagccattcagaatcatcataaatgtcagtatagatctgagcctttgtagcctcatccaaacggtcgccattgttaaccaacatatctgcattaccggaaatagaacaaagtggcgttcgaaggtcatgagagattgcccgcagaagatctgcccgcatctgctcgtttttggccaaaactgcatttttctctttttccatggcgttttgtgcattttccattgcaagcgcacattcatttattacagacagcaggatactgtattcaaaatagtccagtgtttctttttgcattggtattccaattacaccgtaaacattgtctccaccccggattgccagatataagcatttggcctgtggaaaatgatgagtggaagcaccggcacgctgcctgttttcatagacccatctggctacaccctgttcttctggtgttaatatattttttgcactctctttttccaccgaaaaaagttttccatctgataaatttccgttttccactacatacgctgtaatattgcgatttaataagcgaagaagctgagtacaggtaatatcaagaatctctgtccctccttttgccttttgcagcaggcaatctgtatcaaacaaaacttgtgtacgaaaagcaagctgagcagacaattttgcatgtgttttcagctttgctgcaagtgctcccgtaagcacagatgaaataagcattatgagaaaagttaccggataccctaccgcataagtctgaaaagacatcctgggttctgtcagaaaaaagcaaaataaaaaaacacttataacagatccgaccacactgcaaagataaccatctgtcaaaattgaagtaagcaaaactcccaatatatatatcgttacaatatttgtatccgtgaaattcagtctctgaaacagaagaccaatcaaggtacatactgcaaatataattaccgtgaggaaataatctttcgctgacggtttttctacataccttgcaaatgacctcttttgatgagttctggtttttagcgcatccggaataatatggatatcaatatccggtacaatttcaatcagtctttctgtcagagttgctttgctgaaaaagtgattcctcctggcattactttgtccgattacaatttttgttacattggataatctggcatactctgcgatttgtacaggtatgttttccccatgagtcatcactatctctgctcccagcttttctgcatactgtatatgttcttctaacttttctttatctaagacttctgattttataccagttcgtacatacaaggctgtaaaacgtgcctgcagcactttcaccattttggccgctgtatctattatttttttattggagggtgctgctgacagacaaaccagaatatgttcgcttagctctttattattctcctctgctttgaaactcatttcatcttccacccttttctgctgtttttaaaattatatcatgcgactgtgttatggtcaaaagtcttttctacctcctctgaatgtccatcaaaaatcaatattccttattccattaccatcacttattccatatcctcttcatgacaatcacgctatatacggaaacacttctgaagatcccgatactctcctaataccagtaatttattattctctgcaaaacatgtatccggagaaatcgaaatagtgaattctccttctttttttaccgccagaatattaatattgtaacgttttctaatatccagcccgcctactgtttttccaatccattcctctggtacttccacctcaaaaatcgcatgggaagcatccacctccatataatcaaggatatgatcatctgtgtaacggatagatgcccatttcgcaacttgcttttctggatagaccaccttatctgcaccgttgcgcaaaagaaatttttcctggacatcacgttccgctctggatataacaagttgtgctcccaattcctttagaagagaagttgtttcaagggaattttgaaaatcacctccaatcgtcacaaagcagatatcgtagttgccaatcccaagagatcgcagaaattcagcatttgtactgtccccaatctgggcattcgtcacaaatggcaacactttattcaccctttcttcattccagtcaaccgccataatctcatgcccaagctgattaagctgtatagcaatatgccttccaaatcttccaagtccaataatcaatatattcttcataatatttttttctccttatccaactgtaattttctctaaaggcagccttgcatttcccctgtttcttccggaaaatactgcataaatcagggtcaatccccctacacgcccaagatacatcagtataattaacacaacttgtgaaaaaacatgaagtttcggtgtaattcctaatgtcagacctactgtacctacagccgaagctgcttcatacagacagtccaaaagaggaatatcttcgtatatgctgattgcaagtccaccgcaaaaaaacaatgtaaaataaagcatggatattgttgctgcatttttaatcgcatgatattccagtctccgtccaaaagcccctgcattttcctggcttcgaaatgtagctattgcatttaaaagcagtactgtaaaagttgtcgttttcattcctcctgctgtagatcccggtgaaccgccaatcagcatcagcagtatcataaccgcacttgatgcctcactcatctctgaaatatttatagtattaaaacctgcagttcttgtagttactgattgaaatgtggcagctaacagacgctgccctgcaggcagatttttcaaatcatagacaaagaaaaaaactgccggaaggaaaatcagacatgccgtcgtcacgagaatgatcttactttgcatacgataacgtttaaagttcattttattcatatagatatcgtcccaggtgataaaaccgatcccccctataatgatcaacagcataattaccacatttacaatggcatttccagaatatctcatcagagatggaaatgtattttctgttgttcccagaatatcaaatccagcattacaaaaagcagaaactgaatggaaaactgccatccagactccctttaatccataatccgataaaaaaaccggtaacaataacatggctcctattgtttcaatcagaatggttccctttaagatgaatcttgtcagtctgacgattcctccaactttaggtgctgaaattgcatcctgtattgtacttctttgcataagagatattctttttcctgaaagaagagaaaccgctgccgccacggttactactcccaatcctcctatttgtataagcacaagaataaccgtctgaccaaacacagaccaatagcttcctgtatcctttactacaagccctgtaacacatactgccgaagtggccgtaaaaagtgcctcagaaaatggcgttggcacattctccaaagtagaaatcggaaacatcaaaaggatagtgccaaaaaggatcacacctgcaaagcccagaataatcaattgaaaagaggtcagatgcttcttacgtattatctttgacataactaattataactccttactaataattctaatgctatatcttcgtaatatattttattatatggtgttccgaagttatggaaattgcatagcaatggaacaatccggttatatctgtaagtgccaaaatttccttttgacactcacatcattatatatgattactttcaaagatagtataaaagtctatgattctgtattaagatagtataaagattttatttttaaatatgttctaattattctgccaacattctgaaagataatattatagccgcatgatttaacaaaaaatcatgtggctttatcggagaaagtattgcattgaataatgtggtgtctatttactttgtaagcttcctgttatcaaacgccagcctcatctgatgccattcaacatttccgtgtgtagatttttccgacacaccctcatccaaaaagccaaatttggcatagtatgaaaccagcttttctttacaagtcagcacaagacccttacgtccctgctgctttgcgtcatgaattgcacgacgaatcagttctcccgcatatccgtttctacgataatccggcaaagtattaactccaaaaatcatctgccatgctccgttttcgttgtgcatctctgcttttgcatacatttcatccgtcaagtcctcttcatctgtcacaaaaccatccacaaatgcaatcagtttttcagcttcatacatcagccagaaatgatttccataatatctgattctttcaataaattcttcttctgttgcagcttccgcaggtggaaaacactctgcctcaacttcggcaactgccgtgatatcttctgctgttgcatattttatattcataatttttttcctttatcaaacaatttttaacatctgaatcagcaaaatccatgcaagtccataataagtcacaaccgctaccaggtcatttaccgttgtaatcagcggaccggaagccactgccgggtctacttttattttatgaaaaaggattggcactaatgttccaaccagacttgaaataataattgctactaaaagtgagattccaacacatcctgaaatcaaaaaagcactttcaaatgaatatcctttaaataaagcaatatagattcccaaacagacaagtgccataattccaagcaatgctccattacaaaatccaactttcatttctttaaataataaatgaagtttatctttaccacttaaattttcatccatcaatactcgaatagtaacagcaagggactgagttccaacatttccggccatatcaagaattaaagactgaaagcagattacaacaggcaggactgcaacaacaccttcaaacgctcctacaactgtagaaactcccattccaagaaacagcaggataaccagccatggcagacgctttttcatactctcttttgttgtttcatttaagtcctcttctgctgacaaaccggcaagttttgcatagtcttcacccatttcatcatcaacagcttctacaacgtcctgtgcggtgatgatacctataatttttttatttttacttaaaacaggcaaagaatcttccgcatagtcctttattttttcaatactatcggaaattttttcccggtccaataaataaggatatgcataactgattaaactgtctaactcttcattttctcttgcaataatcaggtcttttaagtcaatcgcaccacaaaagcatcctttctcatcaacgacataaattgttgtaatgttatcattttctccagcctgccgaatcagttcatgcattgcctgacgaatcgtaagattctgtcggatgcaaatataattcgttgtaatcagacttccaatctcatcttcgtcataagagttaatcaaccgaatatccgtcttggtttcatcatcaatcatcggacgaagcttaaccttaacgctttcatcgatatcttcccataaatcaactgcatcatctgcatccatttcattaataatttctgccagtttatcaatgccaatctcttcaatgtattctgacggattatcaatatacgcaatgatttctgccatccattttgcatcgagtgcactatataaaagatttcgctctgctctgtttaaaaactcaaaactttgagcaatatcattttcatgataatctctaagctgttccctcatttcttctatggaaggggatactttaataatttcagcaatttctttcgcaaaaatcggttcttttaatacttcttttctcataataagcctcctctcaccctaaaaaagggcataaaaaatccatcgtaacaacttctgttacacaatcctaagatttataagttgtgaattcgttcctaacgatggattaagacttattatttatattcaatgggataaaatggcgtacttatagacacttgaaataaaatccaagtctatatccatcattatatgtacttcgacttcgactctcacaactgaccatacgactatccgcctccttttaattaaacttaaataattttttttgcgtagtgattataacacccttatttgtttggttcaagccctatttggaaactttacaaagatttatctaaatatagagccaaaaaccttataacttttttataagttatctactgtattaataacttcttctgtcttttcccattctttgataatatgcttttttatcaaaatacattctctggtccgccagaataatctgctcatcaattgaacagacttcttctgacaatgcagctccataggatatattaagtttttcaacctgtttgccatgccattttgcaactgccttttcaaaattttcattcaaaacaaataatttctcaaccgtttcttctaatattactacaaactcatctccacctgtccgatagcattttccatactttccatacacactccgaattgtagatgccgctcctcttaacagctcatctcctgatgcgtgcccaagcttatcattgacttcttttaatccatttacatcaaatatcgcaacaacaatcattttttcactcgacgcttcttttctgattctgtccagactttcctcataagcccgacgattataaagccctgtcagctcatctttgtaagcagaattaaacaaacctctgtcccgctttgcaataatatgaagactgattccaaccagcaataagcaaagaaaaaatactactacatttgctaaaatcaaaacataattattgacataagcataagtatctaaattgtgaataaccatataccagtcaaattttttcatatatttcgtaatggtataatttttactttccggatctttctcatacacataatcatcatggtcgtcttctttgattatcttctctggaagtttctgtaaaaatgaagcatatttctttgcatctccgcttcctacctgaatgtttccctgcgcatctgtaaataaaatatcgataccatactgcttttcatactttgcaatctgcttctgaatttcctccaattccatactgacaccacagactcccagaagatttccctctttatcttcaatcctcacatcaatataaatcagccacaggtccggatattcttcatctccccctaacattaccgtatactttttaccagaatctacgaatttctgataccatacatcatcctcatcattttccacatccataatcttataaaaaccatcataagtataataggctttcgttttttcagacgctacaaatacagttctataagagaaatttttcatatatgaagtcgtatactcatccatttctctgcttatttcctcagcatccatcttttcttcgttttccaacaattcaatcaaaaaatgatccgaagccagtgtattcgccacaataaccggctctaacaaccgactgttgatatcattataaattcccgccgcaatgatttcaccattcttcaatgcatgtttttgcaatacctgatacaaagataccgtcgaaataacggtactgctaacaaaacataaaacaataaccataagcatcaggagaaaaaacctgttctttttcataaaattcttcctcatattcttcccgctaaaacattacaaatattatttttattcgttttagtgagcatagtataattattttagcacactaaagagcctttgtcgaataaaaatataatgtaaaattattcaattatttgcatttttatatatttttgtataaactttcacaaaaaatgattgcataaactgcttcaactatgctataataacacaacatttaagaactattttaccaaacagcggagtaattttacttgtccgcttaactaataaaaacagaaaaataagggtgtgcctgaatttcagaagactgccaaaaaagacgcatgaaagtgcgtttcttttggcagtcttttttattttagcaaattttatttaattcaggcagaaaggagtttttcatgcttgtaatgattgataattatgattcttttgtttataatcttgcagcctactttgaggaattaaatcaggatatcaaagtcatccgaaatgacaaactgacgattgaagagttagaatccattgaaaacctggacggcatcattatctcgccgggaccgggtcgtccacaggatggcggagtctctttagatatcgtccgccattttgccggaaaacttccaatcctgggtgtatgccttggacatcagattatcggacatgcctttggcgcagtcgtaaaaagaggaaccgttccaatgcacggaaaagtaacaccgattcataccacccaaagcagaatgttttccaaccttccggaaacttatgaggtaacacgctatcattctttggtggtggacgagagttcccttcctgatgaacttcaaattgatgcaaaaaccgaggatggtgcaattatggcactttctcataagacctatccggtttatggaatccagttccatccggaagccgttttaaccaaatacggacatgaacttttaaacaattttattacaatctgtaagaaatggaggactcacgattggcagtcagattttgcaaactaaaacaatactgcccgacggcagatttattttccctttatcataccagagaaaccgcttttttagattcttctcttaccaataaatatggaaattattcgattatcggactttattcatacttaaaagcggaagaaaccgatggcatcttaaaagtaaacggaacaattcaaaaagaaagtttgttagatttcttaaatcaatatttaaaagaacacaaagaagaaaatccaaccaatttaccgatgcttggcggagctattggctatctctcttatgattacggcaggagttttgaacagattccaagccggcataaaaaaaagatttcaatgccggatgccatgtttgagttttttgatttatatctcatcgaagatttaaagaaaaaagaactgtatctttctacaagtgagcactttcatacacttgaggaatacaggagcgaaatcatgcaggatattttaacacttgcctctaaaaacgtcactgtagactctcgtctttgcgatgttagaatcaaatccgattttgtaaaacaggattatcttaatgccattgattccatgattgattatattagggcaggtgatatctatattgcaaatatgacccggcagatttctgtcgagagttcccgtaccccttatgaggtttttcgctatttaagggagcacaatccttctccatttggaagttattttaaccagccggagtttcagattgtcagtgcttctccagaacgcttcttggaagttcacgaccataaggtggaaacccgtccaattaaaggaacgagaaaacgcggaatcactcctgaagaagatttgatgttaaaagaagaactggcacaatctgaaaaagataaaagcgagcttttaatgattgtagatttggaaagaaatgatttaaaccgtgtctgcagacccggaagtgtaaaggtgactgaattatttgaagtcgaaacttatgcaacggtctttcatctggtttctacaattatcggagaactcgaaacagataaaaccgtaccggatttaattgcctctacttttcccggcggttcgattaccggtgctccgaaaatccgcgccatggaaatcattgatgaattagagcacagccaacgcggactctacaccggctctatcggatatctttctttaaatggagactgtgatttaaatattgtcatccgtactgctgtgcatcaaaatggcatttatcatcttggagttggcggtggaattaccgctgaatccgaattggaatttgaatatgacgaaacctggcagaaagccaaagccgttgtcgcagccatcgcaggaggtgacgtgcatgagtaatcttactcttacatcattaactccagatgatggttactggtttgggcttggagtatttgaaacaatatgggtgaaacaaaacactgccgtatttttagacgaacacttaaaccgtttaaaaaaatccgctctttttcttggatttctgccggataaaacatctgccagtcaatggatttcgattcggaaacaggaaattctggactatttaaaagaaaatccgacggaaaacggtgtgttaaaattaacactttcagataaaaatctttctctgacttcaagaaaaaatacttataccaaagaacagtatgaaaaaggctttgctttagactacagcaagattttaagaaacgagacttctccgtttacttatatgaagaccttaaactatgccgacaacattttagaaaaacgtctggcaaaacagcgaggatacgacgaacccattttcttaaataccaaaggcgaactgtcagagggtgcaacaaccaatctgttttttgtatcaggtaaaaaactttttacccctgcgctttcctgtggtctacttgacggtattttaagacagtatctattaaaaaactatcaagttgaagaatgtatcatcaaaccggaacaggtttctgactttgacgaaatgtttgtcaccaattccctgcttggaattatgccaatctgccgccttggcgaacacaagtttacccgacgtacgattacaaatcagttaatgcagacttactctgaaatttaaaaaagacgtcgcacttgacaggctatctttccaaatcaaaaatcaagacaaaacaagagcagacgagatttttcctcttctgctcttgtttcatcttatggtcttttcatcatcacatgattcttttctttttttccctgttccattaactgataggcttctttaaatgcctcttcaagcggaaggactccatgcactccaccaattgtaactgaaaatcgaatgtgtggatattcttctaataccatgttattaattgcttctgcaatacgctttaacttcatttcaaacatctggcttgaaatgttttccataagaagcagaaatttatcaccttcatagcgaatcaacacatcggaacaacggatacagttttctatcattttcgcgatatgataaattacaatattacctgctgcatgcccatatttctcattgataattccaaaattatctccatcaattagtgccagtgcattcatctgagtcatatttttagcatattcatcataatatctgcggttatacactccggttaaaacatctctataaaatttctgattatagtttttaattccctcaataaaatcattgcgtccaagcgggtctgaaatcatttcatcccgcattttataaatcatctcaagcacgtaaggatagccttctatttcgatgtatttcgcaatcgtctcataaatgttttcgccgataaattcaattttgctgcactgatcttttttaacagttgcctttcttgatacacaatttttgcagatttcttttttcccaaatatattataacatttatcggatttataaaccgatttcttttctcttaccggaataacttcgtacgattccacatcaatcagacgtacactatcaaatactttttctaattgctgaaccatttcttttaattctgcttttgttccttttgtgacatctttattgttgtcaaaataaatcgtatctttctcatgaatatctataattcttccaagtacaccgatatatttgggttcttcttctcttgaccacaaagactttgcgattacctgacaccatctctgtccttctggataatttgcaaggaatttcatccgaatctcagaatttaccggtgtcgtctgatgcagagctttcgtcaaagtcttgatattctcactgcctaaaaatgtttcttccccttgctccggtttaataatcacttcgcgcaatctcaacagttttgctccgtattcagaaagcgtaaccgcttcaatggcagaatcatattcaaactgaatttcttccagtcctgctgtgaaaaatttgcgtttttcctgctctttttccaaacgccaggagctgtaacttgccttttccacaattctgctgtccaaaagttcttcggttacttttgttaccaaagaaggattgacatccatctgcgcgtctatatccagactgacctcaataatatcctcaatgtcttttaagcattccaataacaatggattaaatgcaccacactgtccatctaaaatcatttccatcgctttttcttttgaaaatgctttcttatagcatcgttcacttgtcaatgcatcataaacatccgccagtgccactacctgtgcagaaatcggaatttcttctccctttaatccatccggatagccttttccatcataacgttcatggtgccatctgcagatttcataagccacactgaccagtgttttcttttgatacgttggaagttcttttaaaatggaagcccctaacatggaatgagttttcatgatttcaaattcttcttttgtcagctttccaggcttatttaaaatcttctcatctatcataatttttccgatatcatgaagcgcagaagcggtactgataatcaagacatcttcatctgtaagattataagaattcgttttattcatcagacactgaagcaataaacgagtcatggtctgtacgtgatgtacatgaggtccgctttcaccatttcgaaactctacgatatgccccagtatattaatcatcatactgttatttttttctttttcataaatctgctcttccaccatatttaacagacgtttctgtttttcataaagcattaaagtattggtaattcggcgatgaataatataactctcataaggtcgtttaatataatctgttgcaccaagttcatacgctttttccatataggaggtatcattttctgcggaaatcataataaccggtatggtatcaatccaatgcttctgattcatcactttgagtacttcaaatccatccatacccggcattacaatatcaagtaaaaccaaatcaatactggtttcatatttttgaatgacagaaagtgcttctattccatctgatgcttcaagaatctcataattctcacccagcattgcagctaacatcacacgattcagttctgaatcatctacaattaaaattgttgttgtttttcgtttttctactctatccatttactattccttcacgaatctttctctgttttcatattcaatctgacaaccacaagacttggcgcatgagttttatcgcctgaaatgaattccctttttatattttttgcaatttttgtctcgcaattattcattttcgcaagaaactcttttttctttacttttataacaaaaaacaggcagaatcgcttctgcactgcctatgtcctctagtatgatattattctatagtagattttgccagaaatcaacctctttttttgcatgttttgacaaaagactttaaaaaaaaggcagtttcctgccttttttcgtattacctttatttcacttttactttttcggttcttttgctgtaatataatatggaagtgcaacaaagattgctccgcctatcatatttccaagcgtaaccagtcctacattgtagatatatcctccaatgctgacggatgcatcacccgcattcatcaaaccaactgccagtacactcatgtttgcaatactatgttcgaatccacaaatcataaatacgaagatacaccagaaaatcataatcagttttgcagcttcagattttaatttaaatccacaccaaactgcaagacagaccagaatattacagaaaattcctctgaaaatcaactcctgtggagccaaatgcatctttgtttctgcaatctttgcatagtatgcaccaacatcaccactcggtactcctgaaatttgaaatcctactgcggaaattaaagaaccaagtaagtttccaatatagcagacaatccatactttaatggtttctccccatgaaacagaaccgccaagtgaagagcctgccataaccagattatttccggtaaacagttccgctcctgccataacaataaggcttaaggctgctgcaaaggaaaacgactgcgcacctcttaccattgcaggagcaccattgattgtcagatttgcgccccaggtaaaggtgataaatccaccgaatgcaataaataaacctgccattaaagcggaaacaaaatatcccactttatttttctctaaaaaatcagcttttgcctttccggcattacataacgttgcaaattcattcttaaacatatacgttccctctcttttcctctaatgtactctcagaatctcaataaagaccacgaaagtgcatcatatacatgttttgatacagaacacttttcctgtttgcataaaatcctacagactcacactccggattgctacctctgtgttctcacagcaaacgtacatgcctgcttttttgcaggtatcattgtgatgtcaagcggatattcgcaatccgcttcgttacttactcatatcggttaaattcaggtacggcataagccgcacctgaacctgttattttagttgaaaagaccctcacttatataaatgataagtactccacaaacttatttatgtattgaatctattaacttagaacagaccagaaatctttcctgtttcatctacatcgattctttcagcagccggtacttttggaagtcctggcatggtcatgatttcacctgtcagagctacgataaagcctgcacctgcggaaatcttcaggttacgaacagttacttcaaagtctgtcggtgcgcccagttttgtctggtcatctgttaagctgtactgagtcttagcaacacaaatcggacagttgccaaatcccattgcttcaagctgtgcagcctgtttctgagcatttgcagtcagaacaactctcttaccaccataaattttctgaacgatgttattcagtttatcttcgatgcttccctctaattcataagagaactggaagtcatttggctcttcaaccagacggattacttcttttgctaatgcaagaccgccttctccgccttttgcccatacttcagacagagcaacgttaacaccgagttctttacatttctgttctactaagtcaagttctgcttttgtatcagttgggaatgcattaatagcaactacacatggcagtttgtatacattcttgatattacttacatgttttaacaggtttggaagacctttttcaagagcttctaagttttcgttatttaagtcagcttttgcaactccgccattgtatttcagtgcacgtactgttgcaacgataacaactgcgcttggatgtaaatcagccatacgacatttgatatccaggaatttttcagcaccaaggtcagcaccgaatccagcttctgtaattgcataatcacctaattttaatgccatctttgtagcaattacggagttacatccatgagcgatgtttgcgaatggtccaccatgaacgatagccggtacatgttccagagtttgaacaaggtttggttttaaggcatcttttaacagtgcacacatagcgccttctgcatgtaaatcatgtgcagtaaccggtttctgctcagaaactttaccgtaagtgtaaccaatgataattcttcccagtctttcttttaagtctgtgatgtctcttgcaagacagagaacagccatgatttcagatgcaactgtgatatcgtatccatcttctcttggcataccgtttgtctttccgcccagaccatcaactacaaaacgaagctggcggtcattcatatccacacatcttctccatgtgatttttctaggatcgatgtttaatgcattgccctgatagatatggttatcaatcattgctgctaataagttgtttgctgcaccaattgcatggaagtcacctgtaaaatgcagattgatatcttccatcggaactacctgtgcatatccaccgcctgcggctccaccttttacaccaaataccggtccaagagatggctcacgaagtgcaaccatgacatttttgccaagtttctgcataccatctgcaagacctactgttgtagttgtcttaccttcacctgccggtgtcgggttaatcgctgtaaccagaattaattttccgtttggtttgtcagattctttcagtaaattgtagtcaatttttgctttgtacttaccgtactgctccagatatttctcttcaatccctgctttttctgcaatcgcggtaattggctccattgtgcactcctgtgcaatttcgatatcagtcttaaatcccatactaaaaaacctccttaaactaaatagagaaaagctgtccctctttttctgcttcgagtttgtttctattaaaattcacgaataatatgccgaatttttttatcagatcacacttcatgtgtaaaaaagggcaacatttgtggtctacaaatgctgcccagacggtcggcccatacttcgttttaatttcactgtggttttccacactgacccgtcagaaatcaaaactgcttttcaattgatatctataatctaccataaaccttatagtttgtcaatgctctaacaaactaaattgtgtattttttttgttttttcagattaaatcggcgcattatttattttgttgaaataaatgtttcgacatcttcttttgttggcattacacgaagtgcgccttttttggttgtaattaaagatgacgctccatttgcaaattccagcatttcatagagttgttcttccgataaaccggtaattccattctctaacacatagtttaaagcacaagctccaaaggtatcacctgctcctgttgtctcgattgtattttcctgaagaaacggcgcatgaaagacttcttttccctcatgaaatgcaatacttccttcttttcccattgtcacattcatcagtttcagattcggataatcagcaagcagtttatatgcaccttctttgatatcttttgttccggtcataaattccagttcttcttcagaaatctttaacaaatcacactgtcccagtccataggcaatctgttctttcgcaagctccatgctgctccataatggtggtcttaaattcgggtcaaaagaaatcaacattccggcctcttttgcaatagttatcgctttttgggttgcttttctgacttcttcatgtgtcatagacaatgttccaaaatgaaatgcctttgcagattccagatattctttctctacctgagattcacttaacatcatgtctgctcctggattacgatagaatgcaaaatctctgtcaccgtcttcaaatgtatgtacaaaagccagagttgtgtgaacttcctgattttcgtacagatgactggtatcaattttcaattcatttaatgtttttctaagagaagtaccaaactgatcttttccaactacacccagaaatgaagttttctttccaaggttatttaacatcgccagtacgttacaaggtgctccgcctggatttgcttcaaaaatcggatttccctgagcactgactccattttcggtaaaatcaatcaacaactcgccaagtgcaattacatcaaactttttttccatgtcgtttcctcactttattttttattgtttcactttgttatttcatacctgttggggctgttttttgccccaatcaatgttgatactcttattatatcggtattggttttagactgcaatcactaactatatctattacaaaatatctacataagatacattcagaaactactcttaatctttccattattcttccgttgtacgagcccatcttacaaagtcccgaaacagattcctaatgttctttaacattccgtcaaaaactcctgctttataaaaattaatcacaatcgcacctatcggcactgcaagtatcattcccaatacactgctgattttatatccggtatacataaaaatcaatgtcaccagcggattcattcctatcgaatctcccaccatcttcggctcaataattctgcggacaagctgtgtcaccagatataaaatgacaagtcccaccgcaaaactggtatcaccggaaagtgctttaaaaatcgcccatggaatcaatgcagttccagttccaaaaaacggcagcatatctaaaaaggaaaccagaaaagaaatcaaaattgcaaattttactcttaaaatcagcattcctataaacaaaatcagccatatgactcccataattttaaactgtgccttaaaatatccactaaacacctttttgaaactctcagcgagcatccgccatttatcctgtatcattttcggagtgtgttttcgtccaaattccagaattcgatttctgtcagcaatgaaaaaatacgacgacaacaacgtaaaaatggtagaaatcaatgcatttggtaaattttttgcaatatttcctgcataatctacggtaagttcgcttaccgtactgattatcgtaccaatttcctttcccaattcttcctgcgtattatcgatactcacctgcacattatccggaagttctttgatgatgcttcttaaattatgctctacttcctgaaattcttcgctgaagccgctatacaaattcggagcctgctccagaaattttccggtttctgtcattacctttgcacctatgagataacttccgccaatgattgcccccaaaaccataataataatcaccatggaggtatgtttccttgatatctttaattttttttccaaaaattccaccagaggacttgctatcattgcaagaatccacccaataataaacggaagaaaaaatttaaacatttttattcctaaaataatacagagaattcccgtaatcagtcctaaaattgctaaaaaaactccctttaaatgttttttcaatgtttttttcataaattaattttccttcatttgataagatttttttaaatttcttttaaaaattcaaatggctctccatcatgaagaaaatgcatcagcatataggacgtcatgatggccaccttttcttcttttaaaatccgttttacttcttctttatctgcaagcacaatctccagttcttctgaatcttccagtccggctcttgacacagttccggatgcatatccataaaccgttgcacaggattcatcggtcattccgattgtcgtaaaatacggtttttcataagccggatttaccgttaccggttctaatgtcaatccggtttcttctttcatctctctgattcctgctgttttaaaatcctctcctgtctctaccagtcctgccggaaattcatagatataatcatcaattgcataacggtattgtctgactaaaacaactttattcttatcctctttacagactgcatagataattactccatccggatggttttctcttgtattcaactttaaatgtctctcatcttttgctcttgatgctacataataatgacctgcttttcctgttttactttctacatccagatgatacaaacgaacatatggattttctgtcatcggagttacttttttaatggatggcatacttttttacccctttctgatgcaattgtgcaatttctgcttttgtaaatagaaagattatagcgcgtttacacttgtttttcaagacatagccgacgatctaaacaacaaaaaagatatctttcgtttttatccgaaagatatctcttttgttcatctatttattctttttaatttataagacagaaattatctctgaacacgtgctcctgcaccgcccatgattgcttctacttcttttttgcttgccattgttgtatctcctggtgttgtcatggcaagtgcaccgtgagctgctccgtagtttacagccagttctgcattctctgttgtcataagaccatagatcagaccggatgcaaaggagtctccgccacctacacggtccataatttcaagacctttgtagtctttggatttgtagatttcaccatcagcccagcaaattgctgcccagtcatttacagttgcagtcttaacagtacgaagagtagttgctactgctttaaagtttggatatgtttttgcagcttcgttaatcattttcttgtatccgtcaaggttcagttcttttaagttttcgtcgtttccttcgatttcgaaaccaaggcaagctgtgaagtcttcttcgttaccaatcataacgtctacatatttagcgatttctttatttacttcctgagcctttgcctgtccaccgattgcactccacatagatggacggtagtttaagtcgtaagatacgattgttccgtattttttagcagctttgattgcagctaaaacagtttcacaggattgttcagataaagcagcgtagataccgcctgtgtgtaaccaacgtgctccgagttccccgaagatgtaatcgaaatcaaaatcttccggtgttgctttagaaatagctgtatttgcacggtctgagcatccaactgctccacggataccaaatcctctttctgtgaagtttaatccgtttctgcagattcttccgattccatctgttttcatccatttaattaaggaagtatctactccaccctgattgatgaagtcttccattaacataccaacttcgttatcagcgaatgctgtgatgatacctgtattcattttaaagcatttgctcagtccacgggcaacattatattctccgccgccttcccatgcacggaagcttcttgctgtacggattcttccttcgcccggatcaagacgaagcattacttcacccagagatacttcatcaaatttacactcacttgctggtcttaaatttaaattcatgattaatcctccaaatttttatgtattgtcttacaattttgctcttatcatttcactcttacaattttgctcttgcaatttcttattatagcatgtggtttttatttttgttgttttttctttcgtgctttccaactttttaaaattctaagtaagcacctttcatcgggcttgctgcatgttcactgaacagacgaagcacaccatttttgtattttacttcttttggtttccagtttttcttacgttctgcaagcactttatcgatttcttccggagttttttcttcccctgcgataccgatgatatttaatttacgtgcaaatacatcaatttcaattaagtcaccttcttctactaatgcaatcggaccgccttcggctgcttccggactgcagtgtccgattacaggaccggtagatgcaccggaaaaacgtccgtctgtaatcagtgcaatactttttccaagttctttatcactgctgatcgcctctgaagtatagaacatttccggcataccgcttccttttggtccttcatagcggataaatacagcgtcacctttgtttactttatgttttaaaaccgcatcaagacattcttcttcgctgtcaaatggttttgcacgaagtacggcacgatacatttctttcgggcatgcagtgtgtttgataactgcgccttccggtgcaagatttccacgtaagactgcgatacttccgtctgttccaattgctttgtcataaggacggataacatcttcttttgtcacattgcagccataacgtttgttaaattcctgcatccatttgtcgcatctttcgtagaatccgtttttctttaattcttccagattttctccaagtgtttttcctgttacagtcataacatcaagatgtaagtgctgtttgatttcttccataatagccggaactccgcctgcatagtagaaacattctgccggccagcgtcctgccggacgtacatctaagagatatcttgcatttctgtgcagtctgtcgaaggtatcacctgtaatttcaattccgagttcgtgtgcgattgccggaatatgaagcagacaatttgtacttcctgaaattgctgcatgaactaagattgcattttcaaagctgtccattgtcacgatgtcgcttggacgcatgttgtccatttttgcaagtgcaactgcctgacgacctgcctgtcttgcaaaatcaagtaagtcaggactggttgccggcattaaagcagtacccggaagtgcaagtccaagtgcttctgccataatctgcatcgtagatgcagtaccgatgaaagaacatgctccacagcttgggcatgcattgtgttttgcccagtttaatttatcttcatcaatttctccgcgctggaattttgcactatacatacctaactgttccagagtcagcatgtccggtcctgcattcattgttccacctggcactacgatagccggaatatttaaacggcacagccccattaagtttgccggcattcctttatcacagcttgcaagaaatacgcctgcatcagatacagttgcatttccgtggatttcaatcatatttgtaatcatttcacgacttgcaagagagaagttaattccgtctgttccctgactttctccatcacagatatcggtacaataatatcttgctccaaatccgcctgcttctgcaacaccctttcttacttcttctactaagacatttaaatgtccgcttcccggatggctgtctccgtaagtactttcgattaaaatctgaggtttggataaatcctccggtttccatcctgtaccaatacgcagtgggtcaagctctggtgctaatgtacgcatttcctggctttttaaacaactcatgttttttgttcctccttaaattttaaattcttagtttctacttattttattttttatttttactttatggacttttctattactatttattaactatttaactaaatatcctccgtcaaccggaatgactgctccacacagataatcacttgcatgggaagctaagaaaatggctgttccctgcatatcctctccggttccccagcgtcctgccggaattctttcgctgatagttttaaaacgtggatttttcgggtcaagaagtgcttcattcatttctgttgccatatatcccggtgcaattgcattgacattaattcctcttcctgcccagtcattcgataactctttggtaagctgtgctactccgccttttgcagctgcataggccggaatggtctgtcctccaaagaaagagttcatggaagcgacattaataatctttccatagcctttcttcagcataatttttcctgcttcctgacacagtacaaaaatagaacttaagttgacgctgattacatcatcccattcatttaatggaaactcttctgcgctatgacgtctctgaattccatgtgaagtaacaagtacatctaagtctccaccaagtttttcgacgcattcattgaaaatgcggtaaacttcttctcgtttggaaaggtcaccctttatgcctacacagtcataacccttgttacattcttcttccgctacagcaaacaccttgtctgatgttccaacaattgccactttgcatccggcttgcaaaaagccctctgccattccaagacccagtcctcttgttccacctgttacaataactttctttccagaaacatcaaataaattctgtcccattggttttttccacctttctcctggtttttaagtcgtcatacgtcgtatctgtttttatggtatcacactccaatttcacggtcaagttcttcttttgatttcgttttatttcagcagattttataaaaaggcagaaggaaatttgtaagtatttcctcctgccttttttatatcttcttagaatttatgtcttctcagaatctttcttattccatctttttcattaataatttaatttgaatcctgttattttccaaatgacgcttcattgcttcacttgctccctctgggtcatgccttttaattgcttccagcacttcacggtgagtcacaattgttttatttgcaatcgaataatctgtcacatcaataaacagagaaattccactttggattacaggcattagattggttgtcacctgatttccggtcgcccttgcaatctccgcatgaaataagatatctttttccagataaggctttccctgattgaaaagttcctctacttcttttgcatactcttcaatcttctctacctgttctcttgttgcacgcagtgctgccagagccgcaatctccggttcaatcatcatacgcacttcacaaatatccagggcaagactcttcttatcctccataaatgcaaatccaagagggtcatccatcagccccggtgtctcacttacgaaggttccacgacctctttttatttccacaacatttcttgataccagtatttttactgcctcacgaatggttccacgtccgacattcaactgctctgccatttcaaattcatttggaagtttttctccggcttttaatttccggtctgaaatcagttggacaatctgttctgaaactttttccggcagaagtttattgtttgaatcgattgatttcagctttctgccctcagctttttttcccatactccacctcaatctttcctttttcttatttttcggatgttcctgatgcagagccgctcattgatgtttgatttttttctgctttctaatttaatatccgaacttcttctcagatattatagtataccagtaatttcctgtaatttcaataaatttgcaattttcgctttctgttcttctgttgcacaaagcagaggctgggcgcagaccggattaaactctactccggtctgtaccattgcttctttgataatcggaataaactgttctccgattgaataaatttccatcaaagaatcaatcttctgctgacactctgccatctttacaagattatcttctcttgctgcatttgcaaatgcggaagcaatctgcggtacaaaatttgaaattccggctacacagccatttccgccacttaatacattatgtgcgaaaaattcatcaaatccggaatatacctggaaatccgggaattcttttttcacaacctgaataatctctcttgtgtgacccattgttccaacagtatctttaattcccacgatatttttatgttttcttactaattcaagaattaactgcgggcttaaatcataaccggtacggtccgggaagttgtataataagaccggaccatttacattgtctgccacctggtcataaaagttaataacagaatcatgtggaagattaaagtaatatggtgaaattaccataactgcatctgcacctttttcgattgcatagtttgacaattcaatacaatcttttaaaatcatgcagtttgttcccacatataaagtcacacgtttgttgatgtaagaaactgcggtgtcaatcagttttttcttttcttccatagaaatggcgaagaactcaccgatacttccaaggatgaggattccatccataccaccctgaattaaatgttcataaattcttttgtttgcttctaaatctacatgtccctcagcgtcaaaagctgttacaacaggggtaatccattttgcgttcatatctcttctcctttaattctagtatcctgcaccttccattgcggaacgagctgattctgtatatctcttaaacaaaccttttcttggcggtcttggaacgattccatttttactgcgctcttttaagactgcgtctacttcttctttggaaagttcttttccattaattccaaccacatccaaagtacgttccggaatattataagaaataatatctccggtttcaataaatgccaacggtccgccacttgcagcttccggtgatacatgtccgattgccgcacctcttgttgcaccggagaatcttccatctgttacaagagaaacttttccatttaatttggtatcgcacacaattgcctctgtagtcatcagcatttccggcataccactccctcttggtccttcataacggacaacaattacatctcccggttcaatttttccatcaacaactgcctgataagcatcttcttcacgattatacacttttgcggttcctttgtgaatccgcatatctttttcacaggcagagtattttacaacggaaccttccggtgctaaattcccacgcagaattgcaatcgaacctttttctgttgccttttcgaccgggaaaatgacttcatctctggttaatccatagttgcttaaataaccaagatttctctcaaagaaattatctttttctaaatcttcgagattttcacccagtgtttttccggttacggtcattacatccagatgtaacatgtcttttaagtatttctgtaccatcggaattccacctgcaaaccagaaagattccgtcatctgagttccgcttgggaagatatttccgatatgcggcactttatgattgatttcatcaaagagctctggtgtcagttcaattccaagttctcttgcgattgccggcagatgtaaagttgcattggtagaaccaccgattgcactatgtacgatgattgcattttcaaatgcttctttggttaaaatcttagacggtgtaattcctttttctaccagttccataattttacgtcctgccagacgggcataagaaagaatgtctcgcatggtagccggaatgactgcggttcccggaagcgccattccaagtgcctctgccacacattgcatggtgcttgctgttccaagaaaagcacaggcaccgcaggatggacatcctgtcattttataatcacggacttcctgctctgtgattgcctcttttcgtttctgacgaagagaaatatctccagcaacaagagaagttgtcatatttggacctggacgcatactgcctcctggaataaaaatagtcggaatatccagacgggcagccgcttttaaatgtgccggtatggatttatcacaggaagaagataaaatcattccatcccatggatacacacttccgtgtacttctaccatgtcacagattgcctctctggatgccagaatatagttcatgccatcatgtccttgtgcacatccatcacagatatctgttgtatgatactgtgccggatatccacctttttcaaacacgccatattttgcctgttccataagacccgccagatgagtacttcctggatggctgtctccaaacacatcttcgagcataatctgtggtttcttaatgtcttcttcatcccagcctgaacccatctgcagggcatcaaactgtgcccataacagacgctgtggtgcacttttttgttgcatttttttatcctcctgaatttttttctttttatcttatcatacaaaattttaaagttgaaatccactttaattgaaaccaattttccgcaatatgtgaacggttaagttttttatttcttatggctttcttataacaaaattcatacaaaatgtaaactaaaacaaaaagggcaaagaacccttttcgattctttgcccagtttcatatctcactttagttcgatttgaatttttgatttaacttacatcaatcctggtaagaatccctggaagagagaaaggattgatacaaaaatcagaattgcaacaccggctacgaaaccaccgatactccatcctctgattgtatccggtacggagattccgaagaaacggctgattgcccagaatccggagtcgtttggcatggaaagaccaataccaccggcacagatagcaatcgcacacagaatcggagatactccggatgtagcaattgtaccagccatgatagctgctgttgttgtaagggctacagttgtagaaccctgtgcacaacgaataatctggcagattacgaagcacagtaccagaatcggaatactgaatccggaaagtgttcctgcgatataatctgcaatacctgttgcctgaagaattttaccaaaagcaccgccggcacctgtgataagaagaatcagaccaacctggtcagcaccttctgacataattgttgtgatagattttgtcagatattttctggaaactaatgcggcatataaaacaccgactaacatagcaaagtttttattaccaatgaaggaaacaaacggtatttcttttcctgctgctaacggaacgaaacttccaagaagaatcaggataatcggtactaacagaatagacagggcttttaacgctcccattctttcttttcctgttgtatctcccatagatgcagcttcttcatctaaatcatcaaatgtatagaaatgtttgtttttctggtcctgtttgttgatgaatccaccataaacaataccacctacaatcatacctacaaatgcagatactaatgcgtagaagaagaaaataccaatttcaattccaagttcctctgcaactgcaagtggtggtgcagtcggcagtaccagtgcgaatgtacatgttgtagctactgaaattgcacatgcgaaagtaaccatggaaatttttgttttcttgcataatactttcagcatcggagcaaacatgatataaactacatctccgaataccggaatacctgtgataaatcctgaaatagcaactgcgattggagattttttatcgccaaaagcttttaagactttatttgcgatagactcaataccgccagcctcatacatgaatttacctaacataacaccaagaccggtaaccataccgattccaccaagtgtacctccaaatccgtctgtaacggtctgggcaatctcaccaagtggcatgttcgcaaccacacctgtaatgtagccagtgagcagtaatgctacgaaagcgtttacctgaaatttgataatgagtaacagcagaattgcaattgcaaggataaagattgcaaccaatgccggacctgttacgattcctcctgaaaacataccgttttcctccctttttcttttttcaatgcaccctcagagcacatcttatttggttttcatgtgacgtgtgacgtcgtatccattccatgagtagactgtaccagattttatacaaatagtcaatagggcattgtacattctgtgagttttagataattttaaagtttattttttggtaaattttcacataacttttttgtatgttttttcttcatttttatttatctcttttttttaaaattaaatgccgaaatactccggatagtgttccagaatattctggaaattttttctgtaaatcccaagatgtctgtcatagaattttttcaggtcaaagtcctctgtgtagccgattaacagctgatgaaaaattttttcatgttctttctgaattgcttccaaatccgttttactcataattgcatcgagataacgaacacggtcataatgggaactgactcttctgactgctctccagacattacttttatttcctgcctgataaattaactgatgaaatttattgtctaatttaaaaaacgcatcaatactgtcttcatttttttcttccagtacttttttctgcaaatccagattttcttttattttttccacgtaatcctgacttaacgaacctgcaagcgttgcaagaatttccggttctaagaccgaacgcataaaatagccttcttttaacgtattaatgttaatataagaaactttagaaccgctctgtggatacacttctaccaacatctcttcttttaacataatgactgcttcatgtaccggtgtccgactcacatgaaaaatttctgcaagctctgcctcatttaacgtttctcccggaagcaactgcatggtcataatattatctcgaagcactcgataggcatactctctattgttttctttttttcttcgttcgctgattcttaacttcatatttttagttttccccttttctcgtcttttactaatatattagtttagttctttttcttttttactctgcttttattttactatccctctgcctgtcacgtcaatttttttcgagcattttcccctgtatttccttgtatttttcacgtttttgtatattttttacagtttttcattttaattcttggcaaaatttatagttgcatcttcggttctgttctgatatattaatggcagatgcaactgatatatcagttttcatccattatcagaagatgtatccattccttttctcttctggtttctgatattcagattgcaaagagaaccagtaaaaagcaaaaagtaaaagtgctccactttccggagcaaaaggagataaaatcatgaaagcaattaaagtaatcgaaccattcaaagtagaaatcgttgacgtaccaaacccaactatcaaaaaagacgatgatgttatcgtaagaatcacttccggcggtatctgtggttctgatatcggaatctggaacggaacaaactctttagctacttatcctcgtctgattggtcatgaatttggcggtatcgttacagaagttggttctgctgttacttctgtaaaacctggtgacaaagttgcagttgacccggttgtaagctgtggacactgctatgcatgccgtatcggaagacacaatgtctgctccacacttgaagttatgggtgttcacagagacggtggtttcgctgaatttgttgttgctgatgagaaaaacattcataaattccataaagactttgacgaatctttactcggtctggttgaaccatttacaatcggtgtagaaatcaacaaccgtggacagattacaaaaggcgataaagtcctgattatgggttctggcccaatcggtatcgctgcaatgcaggttgcaaaaagaaacggtgcagaagttatcatgactgaccttgtaaaagaacgtctggaaaaagcaaaatctatgggagctgatgaaactgtattagtttctgaagataacttagaacagcgtctgttagacttcacagatggagaaggtattccggttgttgttgatactgtatgtattccttcttcctttgaacaggctgtacagcttgcatgccctgccggacgtatcgtctgcatcggtctgaaaaaccagccatcttctatcacaatggctgatatcacaaagaaagaactgactatcgtaggttctcgtctgaataacaactgcttcgatgaagttatcgcaggatttgaagatggaactctgcatccagaacagttaatgacaaaagcttacaactacaaagacgttatggacgcattaaatatgattaaagaacatccacaggatgtattaaaacttgttttaaaatttgaagattaattaattttgctactcccccttaaagtgatatgtgctctcggaagctttctgtaaaaactccgagagtacattaataaaacaaaaccctcttatgattctggtgcaccatgaaagtggtgcaccatttaagactaagccaaaattttagtaacccaataataaactataaaaaaagcgaaaggatttttgattatgaaagaaatttatatcaccaacaaagaatccggaatttccatggacgaaatctccaaagcaatggacaaacttctctctcagtatccaaatctcaaaaaagtattgattatcccgcctgattttacccgctgttactcttacgccggcgaaatttcacagattttatataaaaaacttgctccagaagcagaagttcatgtaatgccggcacttggaactcacatggaaatggacgaagaagaaaaacaaaaaatgtttgcaggcgtgattccgaatgaagcatttttagtacatcactggcagaaagataccatttctatcggtacggttccaaaagaagtcattgaagaaatctctgaaggcttatactctactgatatcgaagtggaagtcaatgaaaaactgattcacggcggatatgatttaatcctctctgttggacaggtggttcctcatgaagtagttggtatggcaaactacagcaagaatcttttcgttggagtcggcggacgccagatgattaacaaatcccacatgttaagtgccatctgtggtatggaaaaagctctcggtgttgcagattcaccggcacgaaaagtatttgactatgcacagcagcatttccttgacggaaaacttccgctggtttatattcagactgttacaactttaaatgatgatgatttgaaattaaacggtttatacgttggttcttccagaaaaccatttgaaaaagcagtggaactttccacagaattaaacattgtccatgtagaacgcagagcgaaaaaattagtgacttaccttgacccggatgaattaaagacaacatgggttggaaataaaggaatttaccgtaccagaatggcagttgcagatggtggagacttaattattcttgctcctggtgtaaaagccttcggtgaaaatgaagaaatggataagatgactcgtaaatacggttataaaggacgtgactacgtgcttgatttatttaacaaaggtgcatttgacaataagattatgtctgctgcacacttaattcagggttcttccgacggacgtttcactattacttactgcaccaaaccggaaaatctctccaaagaagaaatcaacagtgttggctacgaatggatggattacaatgaagcagcttctttatacaatccagacaccttaaaagaaggctggaatactcttgaaaatggagaagaaatttacttcgtaaaaactccggcacttggactttggaaagtagattgatttttattctaatttaaaactcccccatattttctctcttgagaatatgggggagtttttagtttatcttattaaatttcaaataagaattaagcctgaggacctgcagaaacaagtgctttaccagcttcgtttccttcgtatttagcaaagttcttaacgaatctgccagcaagatcttttgcttttgtttcccattcggaagcatctgcataagtgtcacgtgggtcaagaattcctgtatcaacacctttaagttctgttggaacttcaaagtcgaagaatggaattttcttagtcggtacatttaagatatctccgttgaggattgcatcgatgataccacgagtatctttaatggagatacgttttccggtaccgttccatcctgtgttaacgaggtaagcttttgctccgctctgttccattttcttaaccagttcttctgcatattttgtcggatgtaattccaggaatgcctgtccgaagcaagcagagaaggtaggtgttggttctgtgataccacgttctgtaccagctaatttagctgtgaatccagacaggaagtagtactgtgtctgttccggtgtcaggatagatactggaggaagtactccgaaagcatctgctgacaggaagattacgttcttagctgccggtgcagaagataccggacgaacgatgttttcaatgtggttgattggataagatacacgtgtattttctgttacactcttatctgcgaagtcgatttttccatctttgtccagagttacgttctcaagaagagcgtcacgtctgattgcattgtagatgtccggttcagattctttatccaggttgataacttttgcgtagcatccaccttcaaagttaaatactccgttgtcatcccaaccgtgttcgtcatcaccgattaagagacgtttcgggtctgtagacagagttgttttacctgttccagaaaggccaaagaagattgctgtgttttcaccatttaagtctgtatttgcagagcagtgcatggaagcaattccttttaatggcaggaagtagttcatcatagagaacataccttttttcatttctccgccgtaccatgtgtttacgataacctgttctttgcttgtaatattgaacattacagctgtttcagagtttaatcctaattctttgtagttttcaacttttgctttagatgcgttgtaaacgatgaagtctggctcgaatacttccagttcttcagctgttggtttgatgaacatgtttgttacgaaatgtgcctgccaagctacttcaacgatgaaacggatagccatacgagtatctttgtttgcaccgcagaatgcatctactacataaagttttttgttagaaagctctttgatagcgatatcttttacagtatcccaagcttcttttgtagctgggtggttgtcgtttttgtactcatcagaagtccaccatacagtatcttttgagttttcatccataacgataaatttgtctttaggagaacgtcctgtgtaaacacctgtcataacgttgacagcgcccagttcactttcctgacctttatcgaatccttccagttccggttttgtttcttcagcgaataatgtttcgtaagaaggattgtatacgatttctgttgttcctgtaatgccatacttagttaaattgatttctgccatctttacacttactccttttctttcattcctctggaagtgaattttctcacttcccacttagtattatacatgatatctaaataaaatccattaaaatttttataaaattttttattttttctatctttcacaattattcgacgtcagacgtccttttctatggtaaattaatacagttttgctaagataaatcttcttttgctccctttgttttccattttttatgttgttttgatttcctgtacacacaaaaaggatgtcctttactctcccaaataaatgacatccttttttatacccttttttcgatatcaatatccctttttatcccctacaggaggcctcgctttcccgcttccattacagcttctgctttatttgagactcccagcctcttataaatctgctgcgtatggtattttacgttactcaccgacatatttaaccgttctgcgattttctctttagaaagaccatctgcctgaagcttcagaacttccagcattgcatcacttaacgtaacgctctcgattcccgccttcaaatatcccggataatagcgggtcattttttccgtttcttccaaaacctgcttccagaactgccggttctttttttccccttcttttgattctaccctcgaaggttcccatctgctttgcgtaagcaatgggcggattgcagctccctcacgtgtaataatccgcacaaaatgatattcctctgccatttttaatccttcacacagagtctcatcccaccgttcatccccaatacggtactgtacaatcgccatcaataatttcacttcgattttgatataaatgcgtttcattactgttgcatagtactcacattttaaaagcagattgtacgcctgttcatttctcccattttgcagatacacacgtacttttgtcagataatgaaatctgtcataaattgaaaactcctgttcttcatccggtgctttcttcatccatttctcaatctctgcttttttctggctgtagagcgcacatcgtataataaaggtttcaatattcggaagcaggcgttctgcttcttctttttctgcttttttatagaaccgttttaacagttcttctgcctccgatacctttcctgtaataatatgcagccatgccagcatgccgtctgccacaaagcattgttctaattttcctccggtctctgcctgcattctccccttattggctaaggaagcgacctcatagttgtcctcacccttctcaaaaaagctttctgaaagagccagatttaccataccctttccatatttcccaaggataaattcaaccagttttccaatgccttttgccagttctctgtctctcttgctccactcacagaagtcctttccgccattcatctgagatgcctgattactggtgacagaaaattcctggagactgacctgcttatccaagattaacagatgtgcctttttcagaatttctatcatattctcactgcctctgtgcggaagtccgatttccagatacagtaattcacttctcgccctacgccgctcccttccggaatgttcctttgcatactgttccaattcctgataccagtgttcactctcttctatatccaataaaagtgactgaagcatgctcattcccatcataagctccggactggtacggattttttcgtctgaaagcttcaggtaatattttttcagctgataataataaccattatttggtgcagttctcgcattttctatcagcaaagacgcaatccgctctttctcccctgctttttgatacatctcaagcgcacgaattggttctttatttagctgataatacaagcctgcattttcataaagggcatgtatctgctctttattatactttcgtttcagacgtctgcgcatactgatacacatttcccgacgaaattcatacacaacttcgtctttttctgttctttccatcataaagtttccgagccattttaccctgcttaaaattgattctacattatttatccccgtaatcatctctgccagatgtgctgtaaaacaatctacaatcgaaacttccattaaaaattcctgtattcggatatcccagttgtcatagacatgccagtcaagataatcccacatctgggataaccccctgtcaatcagctctgaaaataatttatccgaaaaatactcgccctcttttagtccctcacgaagctgaatctgcttatatatatcccatgtaatataccagccaagcggaacccccaaacagtaatttctacttaccttgcgctgttccggcgtcaacagtatctttgtatattctatgtattgattttcctgagcttcatcaaacaataattcagactcttctatcacataaaagacttcgcggtaacggacagcagcaagccacggtggtacggcacatctccccgataaaatcagccatacatcttcccgttcaatcaacgaaataattgcttctttgatatcttcacattcttcctccattgccaaatcatgcagattatcaattaccacaatctttcgtttttcagattctgcaatcccctccagttcttctgcgcttacccttccagcatcaaacatctgatattttttctgttttaaataacggacaatcagttctgtcttaccaataccgctcactccgtaaatataagcagttatattttcttcttcggcagccttcaaacgcctgagtgcccgttttggccggatataacatattttgtccttttctgtcaatgatacacccctcttcctttttcctttctatacatagaattataacaattttcgacatctttgtatactaaccaaacggctagtattttcaaaaaaacgcagattatttgaacgcagataagcattcccctgcttcaagtgcgcaaagcactaagcagcgggtaaggggggatgcttatgtcagcgggagttgaaaactcccactgacagattgcgaagcaactgcgttcatgagcaagtagcgaagcggattgcgaatgtccgctttacttacatgaagctctgtgttacctgaaatttctgcacggatgtttttgtcaaaaaattttacataaatttttcatttctgcgcctgcatactttacaaatgatttctaaaataacagtaacgaaacagaaaaagaatttttttatttttattcattaatttagaaacgggggatgacacatgtatcagaaattatggaactttacaaaaaaacataccaggaaaacgcacaccgcttttctttttctcttcactcttattaccggatggagcattgtcggacttgttatcggcacacttttatgcctgacaactgctatgagccttccggttcaactcaccgtacttttatgcaccaccggatatgccggactgattcccggattctttgccggaatcttctttctttacaaattgaatctgaaacgtcctgccggattaacgtatcattctaattcagaggagcgcacaataaagctgctataaaagtgaattctttttgttaccgcaaccgtaggataatcccattctccatttttttaactatggtaaaatagatgccccatgcaataaatgccaaaaagagaatcaacaacccctctccagcattgttgattctctttctttcatgcctaaacttaaagcctagaaaaaacgcacattatttatttcactcatctaactcaaaaatcttattatttactagttcatatttgccgccatccatatttttacgaacaaacggcactccttttcttacataaaacacattctcttcaatcaaagcatccggattctcagaaggactaatcgtcccccctaaatcatcaaagctttcatttttacggaaggtattatgaattgcctcctgcaagcagaacatcacgcagccgccttcattttgtctactatagttatactcatagattgtgccatcccctgaatctgcatcatatgccatgccatcctggttcaatctcgtatcagcgacttcgttatagcgaaagagcgcatctttacacttccaaggccagattcctgctgctacctttcctgctttatctcctggattgcaataaatccgatcattcatctcacacgcaatcgaatctgccatattatgctctaccagcggacgcagcgcatacattgctgtaattccgtctcctcctgccgctttcacataattatcgcaaatcttcatattttcatgtccatacttcaagaacgtttcttcgtcaagctctgccccctgaaacttttcatgtgcatacgtgtagcctactgcaatcccccaacggctcacctgatacacaaaacaaccctcaacggtaacatcctgataacgtgccacacccgtagtctcttcacattttggacgaagcgctgtcatgtaaattccaccattattcatgtgtttatcatacacattgccatgcacatcatgaatcagcagattacgcagcgtaattccgtgccgcacccctttatcttttgccacaactgcaaccccggtgcgattcattttgtctccaagtgaatactgctctccgatgatctcgcttgcctcatttgtaatttccaaatcttccacaataatatattctgcatcatacagtaaaactgcggacgatacatatccgtgatacacatgtgtcggtgcatccaacggatttccataatcctgataccagattccctgtccacatgcttcaatccgaggtggttctccatcgccgtataccccaatcacaatcggcgcttctttactgccactatcagtaatatgaaggtactgtccataaaatacgctgccacgctccagcaatacacggtctcccggtttgaggctgctatgattgattgcaaaaagactggcaaatgccgtttcgcaatttaatccgtcgttcgaatcattccccctcttcgaactcacgtaatacgttttcgataagcttgtcatacgcatcctcccgtaaccgtttttcaataatctgtgcaacttcttcatacgtaaagaaatcaccatgatagcgtccgaataaatccatattttgttcgtaaaatgctcgcttttctgcttctgtaaactccggacataagccagttttgcgaactgcctcacttggctgcacaaaatctaatttcaggcgtgtcaactcatactgcagataggccggagctgaaaaataatgcggtccatagaacttcttattctcctgctccagttttttcagcatcctattatgcgcctgtcgccttgcctcgaatccttccatagaaggtgtttccaataatccaagtttgtgtgccaaaaggaaggctccctgcgccttccttaaacactcctgtttgatacaataactctgtcgcattattttaccgctcctgtaattccatttgcaaaactcttctgtaagcataagaagatcactgctgttgggagtgtacaaattaatacgccaagcatcagcataccatagtcaacgctgtaaccactctttaagtttgcaacgagcattggcattgtgattgctttgctatcctgtaaaataacagttggccataagtagttattccatgcactcatgaaagttactgtcatggctgctccataagtagatttcataaccggaataaacattttgaaaaaaatctgaacttcacttaacccttccagtctcgctgcctcgataatatcatgcgggaatgaacgcgccgcctgacgaaacagcataatcatgaatggagtagagattgacggaagtgcaagcgcaatccaggtatttaccaatccccatgaagtaaacattttaaataatggaatcataattgctacgaacggaagcatcatcgcaagcagcaaaatgctcattaaaatatctttgcctttatcatggtagatttcgaagccgtatccggcaatggagcacacaagtaatgctacaaatgtaatgataattgcattacggaatgagttaaacatcgcaagtttcagattctgcatcccaactaaggttttaaagttttctaccagataaccacctggaaccaaacgtcctcttaccacatcaatacttgtattggttgctccacagagcatgtaatacaacggaaatgcagataaaaagcttgcaagaattaagataatgtatgaaattactttttttgtcttagtcacgtttgtcacctactttcatctgaatcgcagacaggattgccaccattataagaataaatacagataatgccgctgcatagttaaatttcggtgtctctacaaaggaaatattgtaaatataatgtgccagtgtcattgttgacttacctggaccaccgcctgtcaagttcatagattcatcaaataactgtaatgttccggatgttgacataattgcagtcataagaatcgttggtttcaaaagcggaaccgtaatctttataaactgcttgaacggagtcgctccatcaatataacttgcttcatatacagagtaatcaatattctgtaaaccggcaagatagaataccatgttgtaaccggtccatctccaaatcaaagcgattatgattacccaacgtgccggccatgtactctggaaccaatccaccggagcaccaccaatagaagtaagcactcgatttacgactccatccggagcaaataaggatttgaaaatcatagaataagataccagtgaagtcgcacatggaaggaaaatcaacgtacggaaaattccttttcctttgatatgtggactatttaaaagctgtgccagtcccaatgctaagacaagcatgatcggaacttgaatgataaaataaaagattgtgttaaataaacattgctgaaatgttttatcctgaaggattctggcatagtttgaaatcccagtaaattccccgtttgtttttctaaaggaaagcaggattgcctgcgccatcggataaaaacaaaatacaaagattaaaagtgctgccggaatgagaaatgcccatcccgtaagattatgccgtttttctaaacctatttttttcatgtttttctcctaaaatagagccgggaacgcaagatgcactcccggcacgtcctatttcactctttaatgattactcattaatattaaattctacagtatcctgagcgtttttaatttcgctgtcgatgtcagcgccattctgaactacatttgtgattgcatctgttaatgcacttctgatgtcagagtagtatgcaccgtaatcgattcccggaacttttcctgcaaaatctacgatatctttatatactgtctgtccaccatagaaatcagaagcttcattgtaaacttcagattcagctgccggtaagtaacttgcgatcgctccggcatttggaagcaggtcgtcatataattctacgctttcgccaaatgttgatttaaggaaatcaaatgcaaggtctgtgtttttacagttagaagatactgcccagcttgccccaccacagtttgcgtaatttgtagcgccttcaataccatctaattttggcatatcaacgattgcccagtttccggactgctcttctgctgcctgaatagaagacatgatccaacatccctgaataacacctgctgcagtacctttgttcatagaagcgatgtactgatcccaatcagtgtaatctaccataactttttcatcgattaactgtttgtaagtttcgatagattttttcagtgcttcgtttccaactaagtccactttaccatctaccattggagaagcgcctgcagactgaagcatttcgattacaatttcagatccgcctgaacttgtaagcatcggaacgttgtttttctcaactacttttttcgctttttcgataaaatcagaccatgttgtatctttgaaatcatctactgtaagaccagctgcctcaaccatatctttacggattgccatgattgtagcaccgttgtcaaatggaacaccgtagttttttccatctactgtagagtctgctaatttaccagcagagaactgtgagaaatcaacacctgaatctgttaactctgtaaagattcccggatagtttgctacgtttttgtggaaggaataatcctgcattaagaaaatgtccggtaatgtgctgtaatcatctgcttctgctgctgtgattaaagcggtttcaatatcagagtatactttttcctgaatatccagtttgaaatccggatgatctttctgatacattttttctgcctgttccattgcatacacgttgaagttcggatcccaacaccatacagtaagtgtctcttcctgtgctgctgcggtatcatctttttttgcttcgctcttgtcttctgcttttccaccacatcctgcaagcacagatgctgccattgttgctactaaaaacattcccaatactttctttttcattgctatgatcctccttagattaaaaatattcttttataaaatatgaaacgctaccccgcattccataagttaaccttactcaacatcatcaacccagcgcatttcacccggttccatatctaatttgtatacacagttgccattgatgtaaacctctgtgtactgtgcttcggatgaattgttaattactgcaatcttcttgctcttctggaatacggttacttcagtatccacatttgttacataataacgtttcatctcattctccatacctgctgcataataaatcgcacgcagaagaattctacagttctgaggagaatatggaagacctgcaaaataaacactatgtccttttccatattcatttacaactaactggctgtattctccgtccattgcaaggacttgataatttttgccctgtgcgtaaactcggcttgttccctcaccaaagtctacttctccatcgatatcttctaagatgaaatgagttgcatccagttcattatacttatctgtattaagtgagaagcacatctcacggtctacaccaagtacatcagataactggaagaatcttccctgatgctggtaagcagtcggttcacccactccgatgaatccgcctccctggtcaacgaatcggcgaatacttgttacaaccgcttcatcaatccagttttcagctccactaaacgcagtatatgcgtctccaacattgataattactttgatgtcttccggaattccgtttttcacatcatcaaaagagataaattctacttcgaatggcattccacttaagcattccaatacgccttctgcggaataagtttctctatgccagattgcatgatgtacctgattagacatccatcttctctggctaccccaacaattgagaattgccaccttaaatggtgctacataagaaggagtttccttcatattttcatgaatttctctaaactctgtaacaaccttctgaatttcatcaataaatcctggccagttacttgcaagttttaaatatccgccgtatccgattcgatccaatggagaacgaagcagcgcacgtctggcttttctccagttatctcttgcttctccgattgggtctccgccttctccaaacacatccgggaagaagtatggtaacagacgaccttctgtataatctacacctttaatatcagaaatcatacgaagggttacaccacttccaacggaacctacgactgcatctaagccgattcctgcaaaatacttgccatacggttctgttccgatccaatgatctccaaggaacatcattgcttcttttccataagaatgtacaatgtcaactaattcttttgccagtgcacacacttcaatctgctggaattcgataaagtcgcggaactgtttactcggcacgcggaacatactgttgtgatatccctgatctacaatgtattccggacggaatttgtagcctgcccatttttcaaatttttctaagatatatgggcttacgcttgcgctatatccaaaccattccacatatttttctctttttttatcatcaaatgtcaatgtgaactgatggaaaaaagttgtaaatcgaacaacgtcaatatgtgggttttcctcacaccatcttttcagtttttcttttacatatttctgagtttttggttgtcttacatcataagtcaactgatgtggtgtatcctgccagtcatttgtaataaagttgtacatatgtaccggatcccaaatcaagaatgccagaaagctgacagtatattcatgatatggtattgtctggatttcaacttctcctgaaacttcatcaaattcccatttatctataggaacaatttctccagttgtgcgatcgattacttcccaccagcgtttcggatcatctaatgtatttacttttaactgttcggtatgaaaaccttccattaaacgaatacgaagtgtctcgcctcttgcggttacacgatcgctaatcaagtactcctgctgaatctcatccggattctgcattgcccactcattatcttttcttgtagtataataagtcgcatatttctttactggttctgacaaaagcgcttccggcatctctgttccgtcgcagtccctcaatgcatctgctcctaaaagattttttagccgtattgtttcgtcaacgatatctgcatcagtcggcagcgtaagtcttcccgtcatcaacactattccctccaaacaacttttttcttatcttttatctgatagctacagtatagcggacttcaaaaacgatatcaattttattgttgctcgttttgttatattttttgctattttatcaataaaatactatttttttatcaattttttatgtataatggatttatagagaatttcattttactattttttcgtcttttttacgaactttatttacctcacgtaacttaacatacaagactcgcacataataattaaaaggatgtttgcttatgagtaatgaatttattaatctcggttccgccaatagccgccctgaagattttaatcttcgttatatttcaatttccaaatatgagggtgactggcactccttgccacatacacatcaattttcagaacttttttatgttctgcgtggcgaaggaatcttttatatagaagataaaaaagtctctatgaaaacagatgatttaatgatcatcaatccctatgtagagcacacggaaaaaacacttccaaataatcccatggaatatattgtgtttggtgtcgaaggtcttgccttctcatttaatgacccagaccaagatggtactcaaggctatagcttctatagctatggttccgacaaaaatcagtttattaacttcgcacaactcatgatgcgggagtttcaggataaaaaatctggatttgaaaaggtctgtcatggattacttcaagtgcttttagtctatattgcgcgaaagcaaaacttgtctgtaatctcagactcttctttccggctttccaaggagtgcgcgcttgctaaacgttatattgatatcaactattcccagaatattacgttagattctttagcagaaattacacatatcaataaattttatctggcacactcatttacagaatgtatcggacaatctccgattaactatttaaccaaccgaagacttgaagcgagcaaagaactgttgacttcttcgaatttgtcggtaacgcaggttgcttccagtgtcggcttttcatctcaatcttatttctcacagaacttccagaagaaggttggcatgtcacccagacaatatcgtaaactgcactcaaagtaaaaaaatcctaacaagtgcaaggcaaattacgctttgcagcttcgttaggctatttttctgcatttaagaacgatttttttagcttttttagtatactttctctacttttctgttataatgatacctagtgtttgttaattttacttatatttggaggcttttacacatgaaaaagaaaaacgctgtacagacaatatcaattccctcagctcactccaataacacactgattcatcaaacttcaaacgtctccgcgaaaattacattatctgattctattttgtccggagccgttatcgaatatcgcaaagccggttacaactttattcgtcacttacatacgaatattgaaatttatcgaattctttccggcgaatgttatatggatattcagtccgaaacactccacttcacagaaggggactttgtcatgatccttcctgatgtggtacattccttttatctgaacaatacctcagactgtgagttccagcatattcattttgatccggatctattttcaacgattatccttgataatgatgggatttttccgatcacattgcttcatgcggtgttattctcttcccatttttattatcgactgcgttcggatgcgacgattgacgagcagattcaaaaattgattgatctgtatactgcttctgaaagtctgtttaccgcagcaaacgtaaatgttgcactgatgaatttgatgctttacattctcgatcataccgaaccggtgcatgaatacaaagaaccacagctacaaaatagctatgtcgcttatgcactgaattatattcacgatcattatactaccaaaatcttacaagaagacatcgcaatacagttgcaaatttcggtccgctatttaagcaagatttttaaaagctatatgggtgtgactctctcaaactatattaatatttatcgcattaactgttcaattgaactaatgcaaaataccaatttaactttgacagaaattgcgctgcaggttggatttaaagactcgcaacattattcaaaggtctttatgaatgtaattaatgagaccccttcacaatatcgaaaaactgtttcaaaataatatctaatacaaaacaggcaggagcgaatcatcttcactcctgcctactttattttcctttattgctttatcaagcggatattcgcaatccgctttcgctacttgctcataaccaaatagctactacgcagcttatcagaaggggcttgcccccctcctgatacaagcaagtccccacccctgcttattgctttttgcaattgaagcaggggacttccttgatttggttaaatttagtcttcttttttacgttttactacaacagttcctgctgccgctgcagacgctgcaaatgcaagtgcccatgctgttacgttcattgtatctcctgttttcggagaagtgatagagctgcttccttttccagcagagccggaacctgtagttccgctacctgtacttccgccacctgtgcttccgctacctgtacttccaccacctgctgctggttttttgttgtcatctttcttgttgtcgtcttttttattgtcgtcttttttattgtcgtcttttttattgtcatccttcttgtcatccgctgtttcttttactttcagatctttgaaggctttttcgattgctgcttttgcttcgtctacctgctcctgagttacattttcaccgttcagtacgttctgatactgttcgtaaacttcctgcagttttttcagggattcttctgtatatttttctttctcttctaatgctttctttgcatcttctgcagttttattcagtttttccatatctgccatggttataaatgtttcttctacttcttctgtgatctcagactcagtaccctcttcatttactgcagttacagcaacattatacttcgtacctactttaagaccagtcagctcatatcttgtttcttttaccggtgtcgcatttactttttcgccatccagatatacattatatccttctactgctgctcttgcgagaaccggatcccaagtaaccagtgctttcgtatgtttaatttcagagatttttacattagtaggagcggctggtttttccggagccggtttttcactttctaatgtagtaaatgtagttgcttccgatcttgcagattcatttcctgctgcatcgactgcgcttactcttactgtatattcggttgcttctgtaaggtctgtcagtgcaaattcagtacctgctacaagctcctcatttacttttgcttcatttacatatacgttgtatcctgctacacctacattgtcggttgcttcgttccatgtaagcttagctgttgtttcggttacttcggttgcttttacttctgctggtgcagttggtgcttcggtatctgtttcttcttctgcttctaatgtggtaaatgtaacagcttcggatcttgcagattcattttctgctgcgtccactgcggttactcttactgtgtattcggttgcctctgtaagtccggttaagtcatactctgtaacagttaccggagaagcatttacttttgcttcgtttacatatacattgtatcctactacgcctacattatcagtagatgcatcccatgtgacttttgcagttgtctgtgtaatgtcagctgctgctacagctgttggaacacttggtgcttcggtatcttttggttcctcttttttcagtgtagtaaatgtagcagcttcggatcttgcagactcattttctgctgcgtccactgctgttactctcactgcgtattcggttgcctctgtaagctcagttaaagcatattcggtacctgttacaagtgtatcatttacttttgtttcatttaagtatacgttatatccaactacgcctacattatcggttgcttcgctccatgtaacttttgcagttgtttcagttacttcggttgcttttacttctgttggtgcagttggtgcttcggtatctttttctgcttctgttgtaaataccactgcttcggattttgcagattcattttctgcggcatccactgctgttacagttacactgtactctgtagctgcggtaaggtctgttaaactgtattcagtacctgttacaagtgtgtcatttacttttgcttcatttacatatacgttgtatcctgctacccctacattgtcggttgcttcgctccatgtaagcttagcggttgtttcggttacatctgttgcttttacttctgccggaacacttggtgcttcggtatctgctactgctttgtctacatatgtaataatcggtgtgatatgcgcagatggtttgcttgggtttccgctattctttgctacgacacggatcatatcgccttgagctacttcaagctcttccgctttttcccagtctcccactttctctttactatttacaagcgttacactcttcttctctgtgccatttacaaagagacttaaggtaacagttccgtttgcatttccagactgacgaagatatggttcatcatcttttacgttgaatgtaacggttccgctcttcggtactcgatatgccattgcagttacaatgtcggagtttggcggtgtagaaagcagaccgtgtacggctggatttgttgtggtcactgtaccctgtggtgcatcaagacctggaccataataagtgtttactgcccagtttggccatccatcactatcatatgtggtcatatttgcccagtcgccgtcgcctctcttcatctgtccaaaccatacatttccctgctgtcttccaacataatctaatgtccagttgtatgtatttttctgtttcactgtatagtcatttttagttccgtcttctgcagtaatgcgaagtgtcattccctcttctactgcagcgccatcttccagctctgtttctccgtttaatacggaaacagttgcggtatctgctacagtgatattttctttcacttcttttacagtggtcggattgttttctgtgtaaggaacactcaggtttgtacctttcacttcataataacaatctttcagttctttatcagaacttgcaactactgtataagttacatcttccattccttcataagaaagcacgatagtagctccgccttttacgatatcggaatcgccaagtacgttttcaccatttttaatggtaactttaacgcctgcatctacgataacgttgttaaggaaatctgctacggttgtgtttttcggaagatcacttacgtttgttccggaaacagtatacacattggatctcagtacaagtgctgctactgcatcactttctgctgctccgatttccggtactgctgtgattgtatgtccgaagaaatcgtgatcgattgtataaccatttctatcaactactactttaccagcattgattgccggagagttttctgcaagtttgtatccatcaaatacggtctttgcatttggatcttcatgtgttcttgcttttttatttgctgctacagaatccggaccggaacctgcatcaaccagtacttttgtaccttcatttacttttacagcagctgcatcgtttggataagtacttacattgtagtataagttattgctgtaagttttatttccgttgatgttccagttacttactgtagccggtgtttttcctgcaaagtagaagatattattttcaatatctaccggaccaccattaccatgagtatagtgccagattgtattgattccttctttaatatagaatgtgttgttgtaaacctgacagtttccggagtttcctgccgggtctaaaggtcccatatcttcattctggctgatgttataacggaatgtattattgatagattccggaccacagaacataattgtacttgcagtatttccatggctgtagttgtactgatagtttgttccatcgccatagtcagcatcccatggctgtccatcgccatttccttttgatgcattcaatgttgtaaaacattcattatactggaaaatcgcatttttacatttccatggccagatacctgctgccacacgtcctgccccaacattctgttttccgatttcattaccatttgcatccagtcttggctgctgctgtgaataatcagtagtattaatctgctctgaaccattctcagatacattatactgaatcaacggtctgtcaagatacattgttgtgattgcatcaccacctacatgatttaagtagttgttctcaattaccacattagaggacgcatatttgtccatcactgcatcggataatgcacctgttgtgaactgtctccactgataagtgtatcctactgcgattccccaacgatttactgtatccagagaacagtttctaatctggacatcattgtatcttgcgattccggtttctccttcatttgttggctttgcaacgataaaatagataccaccgtttgtcatgtgtttgttataaacgttacctgttacgttgtgaatgtaaagatcatttaatacgatatgatctacggttccattgtcttttgcaactccggcaacaccggttcgatccattgcatatgcatcattatatgctttatctttttcggtatcggttgcactgtttctgtcatttgtcagctcaagtccttcgatttcaaggtattcagcatcttcaatcaaaatactggaagatacagtacctttccatttatgattctggttatccagcggagtaccatagtttaactcccataatccatgaccgtttgtattaatctgtggtctgtctccttctccgtaagtagatacttttaccggagcttctgctgtaccactatcttcttttgtaaatttaagcgcctgatcttcaaatacagagccttttttcagaagaatggtatcccccgggttaaggtcaagctcatttaccttatccaatgtctgaaatgcttcgctttctgaagttcctgcgttgctatcttttcctttttttgaatcaacataatacgttgttcctgatgcagcttctgctccctttgcactaacaggaactgccggcatcattgatgccactgttgttccggcaagtaccagcgccagagtactactcatccatttttttctcatgttgttactccttccatattattctatattcttcaaagtaaaccggctgacttgctccatatctccgtttacttgagaatcattttcaagctgtgcgatcttttcatcatacttttgttcacgcacttccctttcgactgcaattcttgcggtttcgagatccgcattttcctcgctgcctccaaaaatccagtctcgactttcataacattctaaaatctcggcttctgtcagctccatcccctcacgagtgagatcattgcagtattgttccttcaaggtactgacttcataatccaaatatagctggaatgtatattccttgagtccataaattacttcgccttttgcaactttttcgcttcgttctgcgttttcgtccttccaacgctgctccaaagcttcatagctgctgtcggatacatccccgcattcttttgcaagatcatacaccgcatgaatatatttcagctgctctacggtattttccgctaaaatttcataaccgtgtttgtcatcatactctttttcccagaaatcttcttcataaattgcattgtaatcttgttgaatctgcattttggtatcatactctacggatttcatacaatttagatattcctctttaccaatcgaatgttctccaaccgttaaatcgaattgcttgtgattattgtattggacggcacacgtggcaattcctgtgactgcaatcacgaatactgcaattccaaacttttgaaactgcgtttttcgattcttcatagtcttttcttcccttctgcatagggttttatcctgcctcctatacgcagactgtatctgtctaattttgacttcattataacaatctgtttctttttcggctcgtcctttttgattgattccatcgctgattttgtcaaattcggaactagaatgaaatttctttttttgtgttcgggcacaaaaaaaatgagcagaaaaccccaaccgactcgtcggataggattttctgctctatagtagataaaaaacaatatcctcgtcaatgacgaggatatcttctatacgggtatttaatactctgcttaaaataacaaagttatccagagttggcagggaatttcctgagagccatttataaatggcctgtggatattcaaatcccattgcttcttgaatatctttcacagtgtatcccttttctttaagaagtgtcttgatgcgtgtgccggtttctttttgcagaattgacaaatacacaggtttcataattttgcacctccatgaaattcaagtcgaaagccaggcttccgactgagatatgccatcccgaaacattatttcattttatcattttcagcaataaaaatccagcttttctttcttcctattctaaaaattttttaatattttcaaacataatttctatcttatccacctttttttctgtgtgataatgaccgcagtaccatttctgataattaagtctatcctcaattttatccaaccattcctctgttgttctatccaccttgctctggtctaatccttccaaaaagacttccgtcggttcatattttaacggtacggtatggcttaacactacatccacattccagctgagttcattcaatttccgttccacgttctgcttgatttcctcagaaggctgttcatccggccaccagccatacccatgaatcaatcggtacattctatcgacactatatgcaccgcctgttacaatagtctgctttccattaaaatcaaaaacctctccatcctttgcaaaaagcaaatccggatactccttttcataataaaccacaccgccacgccataatttttcctgatagcttcctatcgtctgcggtctttgctcatgatttccatgaatacaaaaaaatgtaattggtagggtttccagaaactctttctttacatggtcttttacccatccaaagaaattaatacctgcgtccccaagaataatcaaaacatcctcacggcttgttttgaatttgccgcaaaactgctcaatccgctcaaacttcccgtgggtatctcctgtgatgtaaatcacgattttccaccttcctttaaattgtaaagcgggggaatgcttatctgcgttcaactacctgccaatttatgaattacttttaccagtaattctgcatcaacaggcttcgcaacatgctcatccattcctgcttcttttgctcttattctgtcctccgtaaaggcatttgctgtcattgcaataatcggtattgtttttgcatcctctctgtccaaagaccggatcagtcttgctgcttcatatccattcttgaccggcatcataatatccataagaatgacattaaattcaccaactctgctttttctgaatcgttcaacagcttcctgcccattccatgctttggtcacgtcagcaccttcatttcgaagcacaaattcagaaatttccatattcagctcattatcttctgccagaagaatatgcagtccccgtatagaagcttctgattttttttcgatttcaactttgccgctcctgtctgtattaatccgaaatggaacccggatcacaaatgtagtccctacacccttttcactttcaaggttaattgttccgcccattttctcaaccagcttctttgaaatcgccattcccaagcctgttccggcaaattttgtacggcttcctgtatgttcctgtgcaaaaggctcaaaaacatatttctgaaattcctcagtcattccgattccggtatccctgcagacaaattccatcgtcggcatttctgtctgctctgatggaatttcccggcagctgagatagatatacccgtttgctctgttatatttcactgcattcgacaggatattcatcatcacccgtttcacatgccccggacttccgataagctctcggtgtatgatttcttttttctcccatacaattcggatattctgttctgcggcaatctgcttgatcacaataagcacttctttggaaatactacttagattgaatggaatttcttccataacgacttctcccgactccagcctactcatatccagaacatcatttaccagttccagcaacagattggatgcctctttaatttttgtcctgtattccgtctgtttctccatatcatctgcataatggtctgccatattaaccacaccgcagattccattgatcggagtccggatatcatggctcatccgctgaagaaactcagtttttgcctcattggcggcttctgccttttttgccgcgctcaatagttctgccttatatttttcatctttttcctgttcctgtttctgatgcgccagattggttcggtatgcccagaaccagaatatactaaatatcagaaaataaagaaaaataacgcttatcacacttaatggaaggttacggaacacttctatatccggaagatacgcatagatataataatccctctgcttcagcatgactccgtagcatccgcttccttctttcctcaaatgataaatgtgctgactgtctgtatgctttttcattgcctgaacaacttcgttgtcggctgtattctgtctcaacagactctcatcattactggcaacaacgattccctcgtctgcaacaagaatcgttccatctttctgagtactatagccatttaaaagaccctgtatcgtcagtgtatagtttctggcaaattccggagatgtgtaatagtagattgccacgatacccggtgcatcttttctggcacaggctgcaatatcgatatgtgacccatcttccctgtcaaaccgttccgaatagcttctttcttcatatccggcaaaatccatgataatgtctttttgcagatactccgtaatctcacctgtcagagactcatccatactgtattcacagtccgtctttccctctgtatccagtacaaggataccatccacccagagagtctgaagatttcctttgaggaactcccggcttagctgaccgccgttttctatttctatgttaatatttgtactcatctgtctggcactttcaatcgcacggagaagacttttggattccgaagattcattataatgagtgtaggtagagcactgcactttgacataatttacaatctccaccattcttttctctgcttccgttttttctgtgtggaagaaataaagcagggaaactacagccacacagattccaatcagaccgccgagcagctggattcgtttttcttttttctttctcttaatatccaagatcatccacctccagatacttttccggatcatccagatatttttcaatgattttcagggatgtgccatcctgacgcatttcttccagtgtctgatccatttgctcacagattcctctgtcatcctcttttgcaaaagcaacacctattccggtgatcatcagaggttcttccaggatacggaagcttgcatcataatccttcatatattgaacgatagattcctcgtgtgctgcaaccgcatctacatatcctttcccaagaaacgtatagatcagctccctatgtcccaggctgatcagatttcccagtttcgggattctttcatctgtccgcttcagaaagataccttccggtttggttgtggactggacagccagattctttccctccaggtcactcagtttatagatatcactgttctcatttacagcgaccacctgacggcttgctatatacggtcctgcccagcgataatcatcaagacgcccttccatggaaaagcagcccatgatacagtcaatttctccactctccaccagttcttttttcttctcccagttgatctggacaacatccacctgatagcccattcttttgaatgcttctgtagccagttctacatctatacccgtcggcacgccatcttcattcagatagttgtatggtggatagttatcgctgccgagggtaataacaggtttttctggttcttctttcgtgttatctgtgtttttacaccctgccagggtaactgctaaaaatcccgcaagcagaatgcctgcaagcactctttttcctttcatttttcgtctatccctaactatccctttcgtttttttcatatctgattctctgccatttgttactattctttgaaatatgggcattcataccaaaacagaagatatctaatctttttaggaataaatatcttttgcttttaagttaatgacattgcttattttcgctctaagcatgcgacagtttctacatgcacgctcgacggaaacatatcacacactgccactttttccaactgataattctcttcacacaaaatttttaaatctcttgcaagtgttgcagaatcacaactgacataaacaatgcgttttggtttcatctggagcatagtagaaagcagtgtctcatcacatccttttcttggtggatctaccacgataacatcggcatacactccgtccttttcgtatttttccggaagcacttcttctgcttttccgacataaaactcagcattttcaattttattgagtgctgcatttttctttgcatcttcaattgcagccggtacaatttccactccatatacctgttttgctttctgtgctaaaaacagggaaattgttccgattccacagtataaatcccaaaccgtttcatttccgtcaagccgggcatattcgagtgcagtctgatacaacttaaccgtctgtaccggattaacctgataaaatgaaagcggagaaatctgatatttgatgtctccaatataatccgtaatcgtttctcttccccataaaggaagaatctcatctcctaagattacatttgtctgttttttattaacattcaaggtaatacttgtcatacctgaaatttttgctaattgtctgcaaagtgcttcggcattcggaattgaagttccattgataatcagacagaccataatctctttcgttgtaaatccataacgaataagtacatgacggataagtccttttcctgtggtttcatcataaggttctactttattttcttccatataagaaatgatttcatttaaagtcatttcattaacttccactccaagcaggcagtttcggtttggaataatcgaatgagtccgtccggcataaaatccggttacaatatttccctctttgtcttttccaaatggaaactgtgctttatttcgatagcgccacgggtcttccatgccgattactttttcaatcgtaaagttatcaaaacctccgattctgcggaggtttgcttctactttatttttcttaaacgcaagctgggcttcataattcataaactgaagctgacagcctccacaggctcttgcctgcggacactttgcttctacgcggtcttttgacggctctaacactttcatcagtcttgcaaatccatagtgtttttttgttttcatgatttttgcttcgactttatctccaatcactgcatctttgataaataaagtgtaaccatctgcttttccgattccggcaccttcatgactcatatcttcaattgtcacctgtaccaaatcatttttcttaaattccattttatttattcctcaccgcactgtgtttttcttaagtttgattcaaagaaacggttgtatccaagccagtctttattgtctcccgctgaacggaagatttctgtaatcgtttccatcttggcatccgtattatctgcaaggtttaaagcagcagcctctgcaagtgccggttttttcggtgaaccatattcaagttcgccatgatgtgccagaatacaatgttttaattcactttctaattttgccggaaatcccggaatttcctttgccatatcgtgaatcatctctgtaccgatcataatatgtccgagtaattgtccgtcatcggtataatcattcatcggaaatgcacttaactccacggtttttccaatatcatgaagcattgctgcggtaatcagcaaatcacgatttaagaccggatatgctttgctgtaatactggcaaagacgcactaccccaagtgtatgctctaacaagccaccgataaatccgtgatgtacagtctttgctgctgaatttcccttaaatgtcttgataaattcttcatcttcctcaaagaatttcacaagcagtttatttaaataagcatttttaatgctgtgcacatatttcagtaattcttcatacattccgtcaatgcttttttcactgattggaagatagtttccaggttcgtattctccctcatgcgcctttcttgcacgtttaatgctgacctgaaggcttccctgaaaagaagtaacatctccgatgacatcaatataatcaagtgtgtcaaagtcatcaattccctgagaattcggttcccagatttttgcatcaattgtgcctgtcttatcctgtaaaattacattttcataaggttttccgtttttggtaactgccggctgtttatgcttacacagataaattcctgagattttttcaccttcacgcagttcattaataaatttcataattctcctaacctctggtcctttattggtcctctttctttttctttttttataatgctccgagtgtcacatcaaatgtaacctctacatatccttctgtcgcctgccgcattgcctttacttttattgtgtcaccgctgttacatgcttttagctgttgctggtattctttcatgctctctattttctcgccatttacttctgttatcacgtccgcattttgaattcctgcctgcattgccggagaatccacttccacactttctacaaaaactcctttgggaattccctttttctcggaaatctgtggtgtaattgtttctcctgtgacccccatatagacaatactctgattgttagataatgtttctattagttcttttatctgagaaatagcaagtcctgtcaccatgtttttagaatctcccaaagcaaaagactgcgcaataacgccaatcagttcgccttcggtatttaacaaaactccacttcccttttcacttccaacaatatcagtagtcagtataccatactctgcatcaattttggaaacagaatttgtcacagaagtcagaattccaaagccaatagaatctttatactccatcggacttccgactgcaattaccggttctccttgttctgcactgtaagaatttccaagtacagctgttccgattttacttcttgtatcagattcaatctctgaatctgatatctttaatatcgtaagcccggtacttgtatctgattttaaaaatcttgcatcaacaaccgtatcgtcacaaaactgtacctgaattcgatctacatttttcacaatcccatactgcgtcagcacataaagttcctgcccgttatccgctacaatcactcccgacatctggctttcataaggagtctgaaaccagtcttcatcacttttaacaccgataaccgttaccatcgcttcttttattttatctgcttttttcagtacttccttatacatttcgctataattatcaatagaaagtccggactgctcaccttcctccgattcgcttatgtcttctgtatcaatacccgcatctgtctgttgttcctcttttttctctgtctcttcgtcagttggaatttctactttctgttccgtcctctttttattttcaactgcctgcgaaatctgcggctctacaactgcaaaaaccagtgcggctgtaagtccaaaaatcgctcctgcccctgcaagaactcctgctgccttccacatttttttcctgtctaatggttttttcttaattgtttcttttataaattcatacgatccgtcttccttattctttttctcgtccatgtagattcctctgcttttttggtttttataaaaaactttttgagaacaccctgtctctcttggatgtcttattcctaatcatttggatgtcttattcctaatcattttactttggcatggcatcattttagcagacacttatgaacaatttatgaataactcttttcatttccccggatttagggtagaatgattaaaaacaattgacaaaataaaggtgatcaaaatatgaatgaaaaagcattaaaaactcttgaatattacaagattatcgatatgctcgaagcttttgccacttcttccattggcaagaataaatgccggcagcttcgccctctcgataatctgacagaaatagaaaccatgcagcaggaaaccgcagacgccctctcccgcatctatcagaaaggcagcctttcttttagcggagtgaaggatgttcgcggttctttaaagcgtcttgaagtcggaagtacccttggaatcggagagcttcttgctatccgttctttactggaaaatgcaagccgtgccaaagcttattccagacaagagacagaaaatgagcatacggattcacttgataacatgtttgagttaatcgaaccactttctcctcttgctaccgaaatcggccgctgcattctctctgaagatgaaatcagtgacgatgccagtaccggacttcgtcaggttcgtcgttccatgaaactgacaaatgataaaattcatacacagcttagttcctttgtaagtggaaattccagaacctatcttcaagatgccgttgtcactatgagaaatggacgctactgtattccggttaaggccgaatacaaaagtcaggttcccggtatgattcatgaccagtcttctaccggttctactatcttcgtagagccaatgacaattgtacgtttaaataacgaaatgcgtgaattagaaattcaggaacaaaaagaaatcgaaatgattctttctaatttaagccagcttgctgccgaaaatcttgacgctatttttgatgacgtcaaacttttatccgaacttgattttatttttgcacgtgcccagcttgcaaaatcccaaaatgcgaccgagcctcgctttaaccgagacagaatcattgacatcaaaaaagcccgtcatccattaattgataaacataaagtagttccgattgatatccgtatcggtgaaaccttcgacctgttaattgtaaccggtccaaacaccggcggtaaaaccgtatcattgaaaaccgtgggacttttaactctaatgggtcagtccggacttcacattccggcatttgataattccagactgagtgtttttcgtgaggtatatgcagacattggagacgaacagagtattgaacagagtcttagtaccttctcctctcacatgaccaacgtagttcgttttatggaaactgctgattccgattctttagtactcttcgacgaacttggtgccggaacagacccgacagagggtgcagcacttgcaattgccatcctttctatgcttcacgagcgtggcatccgtgcgatggcaaccactcattacagtgagttaaaagtctatgcgctttctactccgggtgtggaaaatgcttcctgcgaatttgatgtcgaaactctgcgcccgacttatcgtctgttaattggagttcccggaaagagtaacgcatttgctatctcacaaaagctcggacttccgctttctattattgagcgtgccaaagaacaaatcagtcaggaagatgaaacctttgaagatgttttaagcaatctcgaagaaagccgtaagaccatcgaatccgaacgagaagaacttctttcttataaggaagaaatcaaaaccttaaaagaacaattagaagcaaaacaggataaactagaccagcgaaaagaacgaattattgctgaagcaaatgaagaagcgcaccgtattttacgggaagccaaagattatgctgaccagaccatgcgtatctttaataaggccggcaaagacagcatgtctgcaaaagagctggaaaaacaccgttctgatttaaggaagaaaatggacaaggctggaaagaaagttgccttaaaaacaccacaaaaacaaaaatctacccttcgtccgcaggatttatcgcttggcgattctgtaaaagtcatgagcttaaatgtaaagggaacagtcagttccaaaccagattccaaaggtatgctgtttgtccagatgggtatcttacgttccaaagtccatatctctgacttacagttaatcgacgaaccggttatcacaggacctgcactttctcgtaccggagccggaaaaatcaaaatgaataaatccgcttctgtccgcaccgaaatcaatttgctcggaaagaccgtagacgaagcagtctcagaacttgataaatacttagatgatgcctatcttgcacatttaagcagtgtccgtatcgttcacggtaagggaaccggtgcccttagaaaaggcgtacacaattatctgaaacgtctaaaatatgttcaggatttccaccttgcggagtttggcgaaggtgacgccggtgttacaattgtggaatttaagaaataggggttaaataaatggtttcaaaacagaaaattttaatcgtcgatgacgacaataacattgcagaactgatttcattgtatcttaccaaagaatgttttaatacaatgattgtcaatgacggagaagaggcattaaatgcatttgcctcttttagtccgaatttgattttacttgatttgatgctccctggaattgatggttatcaggtatgccgagaaatccgtcaaaaatccaatgtaccgattatcatgctttctgcaaaaggtgaaatttttgataaagtacttgggctcgagcttggggcagatgactatatgattaagccgtttgattccaaagaacttgttgcaagagtaaaagctgtcctgcgccgttatcagccaacggtcgctcctgccggacagcctgccggaaaatacgtagaatatccagaccttgctatcaatctggcaaattattccgttgtctattttggaaggcagattgatatgcctccaaaggaactcgaacttttgtatttccttgcttcctctcccaatcaggtctttaccagagaacaactcttagaccatatctgggggtatgaatatatcggagatacccgtacagttgacgtgcatatcaaacgtttaagagaaaaaatcaaagaccatccatcctggtctatcagcactgtatggggaatcggttataaattcgaggttaaaaatacatgagaaaatctctctatataaaatttgtaatttcctacctgattcttgctttcattggattttttgcagtctccatgtttggttcctctatggtacacaatcatctggactctgtttacagcacttccttatatcaggaagccacaaatattgcccaaaaccaggcttctaaatattatagggaacaggcttccctggaaagtgtagcgcaaaatctggaaacattgtcaaaatatcagaatgtggaaatctggctgattagcaaaaaaggagaaattcttttaaatactgcatcggattcggatgataataaacttactgtcatcgaagattttaatcccggtcattcaaatggaacttactaccagaccggaactttctttaacatgttctctaccgaacatttaagcgtaatggttccagtcacttcccagttaaatatacaaggatatgttgccatccatctgccggaaagtgtgattttgaaccagcagaatcagattatgaatatcatttattctttaattttaattattcttctgattatgctctgtatcctgcttgttttctcttttatggtctatcaaccgcttcgcaagattattgccggtgcggatgcctttgcttccggaaacttaaaatacaacattccggttcatacaaatgacgaaatgggaacacttgctgtcaccttaaattatatgtcagacgaacttgataaagtcaacgaatatcagagaaaatttgtcgccaatgtctcacatgattttcgttctccgctgacttcgattaaaggctataccgaagcgattttagacggcacaattccggtggaaattcaggataaatacttaaacatcgtagtctatgagacagaccggctttataaactgaccgaaagccttttaaccttaaatgacattgatgaaaaaggacgtatgcttgacttttgcgattttgatatcaatgcagttgtcaaaagtactgctgccacttttgaaggaacgtgtcgaaaaaaacgaatttctattgaactggtcttaaccggacagaccctttacgtgaatgccgatatgggtaaaatccagcaggtactttataatttgattgacaatgcaatcaaattcagctctgctgaatctacgattaaaatcgagacttctttaaaacatgagacgatattcgtttccgtaaaagacagtggatgtggaatcccaaaagacagcttaaataaaatctgggatcgtttttataagattgattcttcccgtggaaaagaccgaaaaggtacaggacttggactttcgattgtaaaagaaatcattcgctctcacaatcagcatattaatgtaatcagtacggagggcgtcggcacagagtttatcttcacactcgcccgaacagaagagggaaacagaccggcttaatataccggcactgtttccctcttttttatttccaatcgtattttgtcaggtgtccttctaagcgcatatggtcaaaattgttctgacgcagtgcttcatagagtacaattgccacagaattacttagatttaaagaacggatatctccaatcattggaatacgaattgctgtttcctggttttccagcaaaatttcttccggaattccaccgctttcttttccaaacataatatagcagtcctcttcataatgcacatcaacataagtctgaggtccttttgtagttgccatataaattttcgcacctggatttttctttaagaaatcttcgtaattaatataagttgtaacatccaaatctttccagtagtccattccggcacgtttaattgctttttcatttaatttaaatccaagtggttcaatcaaatgaagtctcgttcctgttgccacacaggttcttccgatattccctgtatttgccggaatttccggctcaaacaggacaatatttaattttgccatttttcttttctcctttaagactaataaatcttctattcgtatattactgataaattttatataattcatcactctgaggcttatccatgtatctggtctcttccccatttcttaaaattcgttcgtttttatcagtcgcttttccgattacagaagcttcaatacctgcctgatttaattttcttaccagaccatatccatcatctgttgcaatcatcatagaaccgctggacattaagatataaggatttaagccaagcaattcgcacacttcaaccgtttcctgacgaatcggaatcttctttaaatcaatatcaagaccaacattcgaaccacttcccatttcccagagtgcgccaaagacaccaccttctgtaatatcatgcatggcagatacgccccattcttttgcgatttttgcttccggcacaacagaaagatactggtcaaagtgttttgctgtctccacaaaagatggcgcaaagcgttctaacaactctgcttctttttcttttgcggcaatggatgttccctcaaggccaatccatttggtaatcacgatatcctgtcccggtttcacggacgaagttaccaacacttcttcctttttaattgttccaacaccggtcacagagattaacggatgttttactacatcagtaatctcggtatgtccacccattacttccatatttaactgactgcaggcagattccactccacgcatcatctcttttaattcttcttccctggtttccggtgtcagaagcatggtaagcataattccaatcggttctgcaccggaagccgccaaatcatttgcagtgatgtgtacgctgtggcttccgatatcttttactgttccggtaatcggatctgtggaaaaaactaaaacgtctccctcttttggctcaaaaactgcacagtcctgtccaactgccggtccgactaatatttcttctcttctgtgttttacttcttttaaaacggaacgaatcaacataggttccggtaattttcctattttcatcacagttactcccgtattctcttctctatttttttcttataccagataaaccagtgctgccggaataatcatcgccagcgccagaataactgccagtacacctgctacaaccctttttttcttacctgtcattttcatcataatttcattcactccattattcttccataagacgacaaaattttgtcaattaaccttgatgcttcactttttgtaagcgcatctgtttctacattagaatctattctatgatattttatcaaatcctgcaagtatcgtttttgtcttggagttgccggactttgttttttcgctttatagacaagttgatacggtttaaacacatctggatttgacgcttcatattcctgtatgaatctctgataaagtttatgtgtcaccagggcatcttcaaaggcacgatgcgcatgttcctgctcaatctgatagtgcatacgcagagcctgaagccccttttcaggcagttccggcactaaaactcttgcaatcttaagcgtgtcaattccctgatgttcaaactcaagtcctgaatttaccgcccattgttttacaaaactgaaatcaaagataatattatgaccaagcagaggaaatccctcgcaaaattcaaccaattctccaacaacctcaccaattaccggcattccctttaccatcttctgagaaatcccggtcagtgccgtaatccgctccggaatcttcatctgtgggtcaattaatgtggcaattcttccggtttctcttccttcttctatcttgactgcaccgatttctaaaatccggtcgttttttggtgacagaccggttgtctccaaatcgagtgccacatagttttccattttttatctcctctatctttgaattttctacattttgggttactccagctctttcttttacttcttacaattcatctcttatacttataattgaacaaaaaccgcttttgcatcattcgtcagcggacttctctttttataatcgaataagaccggataagcacctttttcttcgttttcatttatgacatcataagtaaacacttcaatgtgcgtcatttttatcgtctgtcttgcctgatagctctgataatcggttaacagttttggattttcctcttcttttttataaaaatccagaatctgcatcttataagctgacaaatcatttgcccactgcggtcttgttttcatattttctcttgcgtataagtcaaaaatcataagctgtttaaaatattccagatttgcttctttttcctgtaaaaattcctgtaaaatttcataacgacggattctggtatgagaaacctcgttataaccgtttttctcataaaaatctgccagttcttcatacatcgaaaaggccgtttcaaataagtattccatagcacggatggttttctggaactgaccgctattatagtaaacttccaccatttcctcaacgccttttagctttaaaatctcttcataagagagccagcgtgttccaagcacttcataaggtggttttgccttatgcacgcagccatatccttccgctgcctctgccatataagaaccttttaagacttttaaaaatccaagctgaagctgttccggttttaacgcatagacatcattaaaggaatgtccaaaactctcataattttcataaggaagtcctgcaatcaagtccagatgctgatgtacattctctcctttttgtaccgcttttacttttcttgtgatttcttcaaaatcagtctttcgatggatttctgcaagggtcttttcattcgtggactgcacaccgatttcaagctgaatcaatcctggccgcatcgtctgaatcagagcaatttcatcctcggttaataaatctgctgctacctcaaaatgaaaattcgtaattccgttatcatgctctttgatataagtccagattgccatcgcatgacttttcttacagttaaaggtacggtccacgaattttacctgcggtactttgtgcgcaaggaaaaattccagttctttttccaccagagaaaaactgcggaatcttaactttttgtcaattgaagagagacagtaactgcaggaaaacggacagccccgactgctctcataataaataattttatgttcaaaatcttttaaatcttcataaggaaaaactaaatcatccatattcatgatatctctaagcggtgtctgatggatcgttttgttttcctgatacacgattccattgattccatctaaggattctccctgactttttccgatttcataatagtttattaattctgtcagtgttttctctccctcggcgcacataattccatccacttccggatgtcgttttaaaaatttgggtgcgtcataagacacttccggtccgcccgcccaaatcgtaacctccggcaggatttttttgatgtcctctataatctcttctgcataagaaagattccagatatagcaggaaaaacaaagcaagtccggctttgcctcatagattccttttaaaatctggtctttttgctggttaattgtaaattccaataactccggttcatatccaaaggttcttgcataagaacgcagactgtaaaccgccagattggaatgaatatattttgcattaattgcaactaatactgttttcataagtttctgttcctctttttatttttcaatcgatacaatgttgattatacacatcctattttattttttaaagaccaaaaaagaaaaagacagctttcactgcctttttctcatacaataaaaaatatttattttttctttaattttttaacaaatcgagtttcatctgccggagaatgatctgccataacttttgtatactcattttccacgtaatctgctttttcatttccttttgaagcaaaagtcatctttaagaagattggtgaaatgatggttgtaataacaaccacgataacaaccggtccaagtaaggaagatggcatcagaccaactgcatttccttttgaggcaacaattaaagcaacctcacctcgggaaatcatacctgcaccgattcttaagcagtcctgtgtggaataatgacataattttgcccccagtccacatccgattacctttgtcagtactgcaacaaccaccaatgctactgcaaagatgataatcattgcgctcatatccggaagttcgacctgaataccgatacttgcaaaaaataccggagataacaatatataagaaagaatattaaatcttcttgcaatatagtttgtatgagtcgtgtttgtaataatcagtcctgcgaaaaatgcacctgtgatatctgcaactccgaagaactgctctgcacagtaagaaaacaaaagacaaattacaaatgatacaataacaaaacgctgtaaatctcttttgtatccctgcacccatttctggaaaactgcgtggatgatatatcctccaaccccaacaaatacaaagaaacctatgatttttacaaataccattgccacattgacactcgggtctgcaaggcttgtaattactgtcaaagcaataataccaagaatatcatcgataactgctgctccaaggattgcatttcctgcttttgtgttcaattttcccatctcttttaaagtttcaacggaaatactaacactggttgctgttaaaataacaccaatgaaaaagttctggagtgttgtacttgcagtcgctgtggattcaatcatacctgggcggttaaaaatccatgcaattccatatccgccaacaagaggtattaatacacccataagtgcaatgataaaggatgcctttcctgttctttttaactcaccgatatcggtttcaagtccggcacaaaacatcagcacgataacaccgatttcagaaacctgatgaataaattctgtctcttttaagataccaaggcaggctggacccaaaatcagtccggcaagcagtgcaccaactacttgcggcatctttacccttctggtgagaagcccgagcaattttgtgctgattagaatcaatgccaagtcaagtaaatacgtgtaagaatccatgttttccatctcctctgttatttttttgtattttaaaaaaacaaaaatcgagttaatggtaacacactttatctgaaaacgtaatatacaatatcaccaaaaaaatcgcggcttttacagcagtttttccattctaattgagaatgccgctacattgatttacgttctgcaatctccgccattttggcagcatttaaacgggtatctccatggacacggctataggaaagataaccgttcatacggtcaatcttggtcagattcttagagccgcataccgggcaaacatccatttcaagttcctcatgtccacaatcatcacagtatgccagggaaagattgactccttcgtaatatcccaaatccattgctcttctgactaaagagcgaattgcctcaacattgtatccaatcggataacgtacatactggatttttccaccattacacagttcccagaaacgaccttcgcagtcctgtttttcaattggagtgatatcttctgttacatggcagtggaagctgttactgacataaggtctgtcagaaactccttctacaattccatacattttgcggaactgctctacctgtaatccacacagactttctgccggtgttccgtaaattgcatagagataaccgtcttcttctttgaattgatttaccttatcattgatatactgcagtacttcaagtgcaaattttccatcttcacgaatggattttccattgtataattcctgaagctcatttaatgcagtaattccaaaggatgctgtcattggctttaataatggtttgattttatcggatggttttaaatgtccgccataaaatcctccctcacagtaagccaacggatttgtagacgctttcatttcacccagataatcgtaagtacgaatgtgaagctgtcgaatcatttccagataaaaatcaagcacctcatagaaatcacggttctctgcacgtgcttttgccagaatcatcggaagatgaagactgactgcaccaatgttaaatcgtcctacaaataccggagcatccttctcgtctgccggtttcattccgcctcgttcataccatggacttaaaaatgcacggcatcccatcgggctaatgacttttttataacgtttatacatacttgaaatgtaaccttttccggtaagggaaagccagtccggatacatcgtctttgcagaacaggaaattcctgcctcaaatacatcttctccctcttttcccggtccatgaagctcttcatcgtataagaacacaattttcgggaataaaaccggtttcttatggtctttctttccctgtccgtctttatgtacttcaagcagggaaatacttgccattttttcaaaacgccccattccaagtccaagagtcaccgttacaaatggatagtcgcctcttgatgagccgactgtgtttagtttatattcaattccctgccagccctgatcaaaatcacgacgcaccttatcggctgcatactgttttgcacgttcttctgcaagctcccagtccgggtctacatattttaaaaattcttctttgtacttatgataactcttttctgcataaggagctaagattttgtccacttccggaacagtaaatccaccgtattgctgggctgcggtacttaaaataatatctcccattacatcaaatgctgtatcgagtgtcttcggctcattgtaccacacatttcccatctcaaaaccgccacgcagtacatttgccacatcaaaaaggcagcagttcatggtatccagacgagcggactggtcatgaatataaatataaccatctttacatgcctgcagttcattgcggttcatgaaaaatttacgatacagctctttattcaactcattaaaaatcagacttctcttggttgcaaccagcgcactgtctgtatttgcattgctcttatctccaatataacgaatggactggctcttggtataaacttcatccatcatatgaataaaatcatgtttgtaatttcggtaatcacggtaacttttggcaaccgccggattcactttttcaagtgctccttctactacattatgcatatcctgtatggaaatttccggttttcccatgccttctactttttctgttgcataccggcagataaaatcaatctcctcttctgtaaactgataaagaatccttcctgccgatttatttaccgctcttacaatcttctgcacgttaaattcttcttttgtcccgtctttttttataatacacaccatttcttccacctctatcgccacactatatctggtatgacattttatttctttcgttatttttatcccatatttggtattagccagtatagcacattttaccggtcatgaaaagagggaaacttgcacaaatcttgacgatttatatcaagtatccccttaaacatcttgttttacacgatattgaccaatttgataaaaatttttctttttatttttttctcagcttttctcttacgcttcaatgactccgtcaaatacaacagttgccggacctgtcatataaacaagattttcttttctgtcccagaaaattttcaaatcaccaccaagcagttttacggttacttcgtcgttcgtataaccatttaatacacacgcaacagcaaccgcacacgctccggttccgcatgccagtgtttctccgcttccacgttcccatacacgcatctctaccgtattttcatcaatgacatgtacaaactcggtatttacgccttccggaaatgccggatgcttttcaaagtacggtccgattttttcaatctccagtttctcaatttcgtccatatagaccaccgcatgtggattacccatagatactgcggttacttcataaacatcgtcatttacgccaagaggctgactgataaccttttcttttttataaatcatcggaatctttgcagcttctaattccggctgacccatatttacttttaccagacttacttttccattttctacggtcagttccaaatacttaattccgctcttggtatctacgctgatgctggttttatcagtcaaaccgtaatcatacacatactttgccacgcagcggattccatttccgcacattgcaccctgacttccatctgcattgtacatttccatctcaaagtctgctttttcggatggtttaatcaaaatcagaccgtctgaaccaattccaaaatggcggtcactcacttttattgacagctcagaaggattttctacgttctcttccagacagtttacatatacataatcatttccaattccatgcatcttcgtaaatctcataattttcaagcctctctttctaatgattacatcaatcatagcaagccttgatttttttgtcaatgtggcagaattgccgaaaaaaaattttgaaaaaaatactttatttaatgaaaaaaagctccaccttggaaacccaaggcagagccctttcaaattggaaaagtatgaggagttacttttccagatggcaatctttttttatgcagacatcttatacgaactgtgctgctacgattgctgcaatcattaacggaatgttaaagtgcaggaatgtaggtacgcaagtatcccagatgtggtcatgctgaccatctgcattcagacctgatgtaggtccgagtgttgtatcagaagccggtgaaccagcatcaccaagagctgctgctgcagacatcaggatgatagttgctgccggtgagaatcccatcttatgacacagcggaacgtaaagtactgcaagtacaggaactgtaccgaaagaagtaccgattcccattgttactaaaagaccgattaatgtgatgatagttgctgcaacccatgtatttccattcataaggctgattgcactgtcaaccagttcttctacagcacctgtgctgtttaagactttcgcaaatccacctgctataagcattacgaatgcgatgaagcccattaatttgataccgccgttaaactgttcatcaatatctttaatttttacagctccgaatatgaacataactaaaagtccaccgaatgctgctacaggaagagaaccaaatttaacctgaagaattacgattacgagtgctgctaaaagtgtaatccaatgtttgtattctaatttcaggctttctaattcatgctgtccctctaatttgatatcctgatattcacgaggttttctgtatgtaatgaatacggcaattgcaagaccgataatcatagcaactgcaagaatccagtttactcttgtaacatcaccaattgttattttccatccaaagtctactgcattctggttgatgttgtctcggatgattgtcataaaaatcagaccaaatccgaatggaagagcgatatacggtgctttgtgaccaaatgcgatggtacatgcaacaccacgtctgtccagtttcatcttgttcatcatactcagtaatggtggaacaagaatcgggatgtatgcaatgtgaatcggaatgatattctgagatgcacatgcaatgattaataagattcccagtaaaagccatctgttaccctttacagtttttgcaattttaacagataagatttctgtaatgccggtgtatgccatacaagaagcaaatgtaccaagcaatacgtatgctaaggctgtttctgcgttagaactgaatccgtcgataacgcagctcataatactcacttcatctccggagctgacaaccggcaaacccccgataagaccggctacagtcagagatacgagcatggagagtaatacattaattttcagcagacacaatacacaaagtaagagtactgctacgattacaggatttagcatagaattacctccctcttttcgtaatatttagtttttttattttgtctctaatgaaccactgattgcctcctcaactgctttaatcagtgcatcattcttaataatttcttcacagtaattaatatcaccgtataattctctatcctggtctaaggtagcaacttctttacgaactaagtcatacgctgcctgtgtacctttaccaagacctttgttaccacgcatatcgataccctggcaggctaccataagttccatagcgagtacacgtcttacatgttctgcaattgttccagcttttcttgctgcaatcatacccatagatacgtggtcttcctgacctgctgaagatggaatactatctacagatgccggatgagccagaactttgttttcagatactaatgctgctgctgagtactgaacaatcataaatcctgagcaaactccaccgtgtggtgttaagaatgccggcagatcgctgtacgctgggttaaccagacgttcaatacgtctttcagaaatatttgctaattcagatgtagcgattcctaagaagtcaaagctcaatgccattggctgtccgtggaagttaccgccggagataccagctctgtcttctttaaagataattgggttatctgttacagagttaatttcgatatttacatggtcgagtacgtagttgattgcatctttacttgcaccatgaacctgtggtgaacaacgaagagaataagcatcctgaacacggatttcaccctgacgtgttgtatttttgcttccttcgagtaattttaacaggtttcttgcagtagcaagctgtcctgaatgaggacgtacatcatgtactctgtggtcaagtgcatctacaacaccattctgtgcttcaaagcagagagcatctgcgatatctgcaactttgactaattttaatacatcatataaagcaagagcaccggctgctgttaaagcctgagtaccattatttaatgcaagaccttcttttgcagataattcgattgtaggaatacctgcacgtttcatagcttctgctcccggaagcagttcgccttcatagtaagccataccaagaccaatcataggaagaaccatatgtgataatggtgccaagtctccagatgctccaagagaacccttctgtggaataaatgcggtaacacctttatttaacatgtttaccattgtttcaacagtttctaaacgaataccggagaatccttttactaagttgttgatacgaagtaacataacaccccttgccacatcaattgggaatgggtcaccggcaccaactgcatgagtaataattaagtttctctgaagttctttacactgttcctgagaaattacaacgtcactgaatttaccaaaaccagttgtgataccgtaaacaactttctcctccgctactaagtcgtctaccacttttctggaatcaatgatattctgttttgcttcttctgctaattcgatttttgcattttcgcggcagattaaagcaagctgctccaatgttaaatcatttcctgtaattacgatactgctcataatcgcaccctcttttcgtttattttatagtgcaattatatctaatagtacgtcaaaaaaacgtcgataaatgtaagaaacgcacaatctattttttcgaattgttttattttttagcacaattccccaattagcggacatcattctttatgatgcggacatttgtatcagtacgttatcatggtaaaactgtaagttgaattttttctcaaaaactttgttttttcttttgtgtaaagcggacattcgcaatccgctttgctacttgctcatgaacgcagtcgctttgcgctctgcacacttgaagcggaggaatgcttatctgcgttcaaaaaaagaagctggctctttttagaacccagcttccttactgatctgtctgataaccgaaacggttgtcggattattcattttttctgtcaagcttactgctttcttataatgtttctttgcctggtctttttcaccaaaccgaagcagaaccagtgccatatatgcctcagcacgctccagtccccaatagtatccatttttctcaaaacaggcaatcgctttttcaagatacgttctggcctctgtatttttttccataaaataatatatctgacctacattagaataaaactgtcccagaccatttgttacgactttttctgttcccttttctatcgctattttataataagaaagtgcagattgatactctttcatttccctgcatacatctccgatgtaattatagcaagccgcaatattcattgcatactgtccgcttcccccgtcgcggttttcaaaaaactccctggcctgtgtcagaagtgccctggcttcttcatatcttccctcatgaagcagataccaacctttgagtctcataaaaatacctttttcatcggtatctgtctcatcgattaatttcattccctctttcacatactttttaaccaacaaaagattctctatctgaattccatagaaaatcatctgtttataattattcagacgtgctttattatcatttaaggtctctgcaattgcttcacttgccttgatattcgccagtccggtttcatattctccgatagcaatatcaaaacgaccttttacataatacatttccattttcatttcctgaagctgatgagaatctccttcaaaccggattacctcttctgccaggcgcaaaatttcatctgcctgaaaagaaagttcctggttatcgtcgccatattccatctcccaatgaagaacaggaaagttttcattgactatcgtataatattctttcaaatatgcaattttatattgatataccttcaccagattatggcacttctcatagtggtgaattgtcattgggagatacgcaaaattttttttccctgttgcttttgcctcgtaatattctgctaaaatctgatggtatgctctctttttacctacactttgtttgtcataaatatactctttaaacacctgatgttcaaatttataataaacattccagcctactaagagttctttgattaaatgtcgttcctgaagtttctctaggacacgaaccaatgtcaggcgatccatatccagatgcaaaagctcaatctcttcgatactgactttctccggaaacagactcatacagtttaatacctccaattcctgttccggcagcccaaccagacgcgcttttatcacattgttggttttctgtgatttttcaagggtataccctttttctttcatcagattaatggattccatcaggaaaaatgcatttccttctgtcatgcggtatacattctgtcgtttcttttgatcttcactcaactccggaagaaacttgcataaaatttcgttggtttctttttcattaaacggaaacagattaatcacatgaagccagcctttttttacaatgttatttaaagactccatcacatcggcatctttttcctgattaaacgtgcacatcaaaagaatcttatgcgtaccaaaagtaagaagcagacgatttaacagctgaatactggtctgatccatccactggatatcatcaaaaaacagaaccactttattgtgctccaaaatcttacggaacatgtcaatcactgcctgctccatgacctgataattcagtgcaccggattttccattttcctccatgacttttcccttaaaaaaatgttccagctgttcccatttttcttcactcatggattctcttaaaacctgataatccgccctctgttccacttcccagaaaatatcactccatggacgaaggaaaaattcggattcctcacgatagcaggccgcatacagaccaatcatctgatagccctttaccatctgcattgctttatcaagcagtgctgattttccaacaccgtcttctccgccaattgccacacatctgggacatccatcttttgctccgcccacaatacattcactgatttggtaaatttcttcatttcttccccagaatggcaggttccagataacaccatctgagtttgtatttcctttcacattaaaaatccggtgaaataattcggttacttctgacgatggttctacgccaagctcatccgcaagaattttctccaaatcataatacaatttgattgccatattatagtttccatttaaggcataaatatccataatttcataatacagcttttcattatacggatcctgttttaataaaatattactatatttttgaatttcttccatattttttgtcgcatccgctttatacagtttttcacgtgccactttcacgaaccgtttattatactgttcctgcatggctgaaatccattcctcaaattcataactgtttttaatcatgaaatgagaaagaaatccctgctcctctgcatcaagcaaattctcatcattgagattatcccagtcaatttctggcatacactccggattaagagaaatgcttgtatgaccaactgtcacaaggatttcttttcctaagagtttttttatctgatatactgcttctctaaggttttttcttccaacattttcgttgtccgctccccaaagcacagatatgatttcctctctcgttgctgttttctttacacacaaatagtaaaaaaagccctccgccttcttatatggaaagttcactctctccccatccatctccacataagggcgtcctagaagatatactttaatatttgccactttttatccctcacatttgtaatagaagaacagatgaatattgccatttttcattctgtccggtatctttgatccaggtacaaaaccatacccacttttcagttctatattttagtatactctactcgtacaacttgtgtcaactcttgtcaaattgtctaaaaatttattgaaaatattttctttctagtataagataaacttatcatcaatcttcagagggggaatcttattgttacgaaaaccaaaaatactctattactcaaatggacaaactcaaaaagaaaaagccatcgaaaaagccgcaaaacgccttggcgcagattttatttccatttctgaaacagattgtacccagaccgtcggttatcttgctaaagtaaaaggatttccagtgcataaaacttctattctggaaaacatctctgctgtctgtcaggatgtgatgattctctgctattttccaaatacccgtctcgaccttttacttgcatctattcgaaacggtgaaactcctgctgttgatttaaaagcaatcctgacaccacaaaactgcttctggactttttctcagctttatcaggaattacttgaagaacatttaagtctgttttccaatcaggaatgacccattctatcttatcatagcacaactacattaataatatagaagaaaaagtcggttttcgagatagaaaaccggctttttcttcttagaacatctttttaccaaatggattttttatttcgacaagcttttttactactcctgctgaaatagtgtattgaaaacctgaatatgtcgtttgacattttcataagttccctctgtcattgctgtatttaagtcaaaatagttatgcttttcatttgaagcaatatattcttctactttctttgttaaactgttaaaacttgctgtcgcaatatttacttttctgattccaagtgaaattgctttctggaaatctttgtctgtaattccgctccctccatgcagtaccaacggaatatctacattttcatgaatcttttcaagcacatcaaattccagtgttggagctaccggataatttccatgcgcattcccaattgcaactgctaatgcgtcaattcctgtctctttggcaaatacctttgcatcatccgggtctgtacaacggattccatggtcacagcttccatcttcacttccaccaaccagaccaagctccgcttctacagttgctccatattgttttgccagctctactactttttttgtatttgcaatattttcttcaaatggaagagtggatgcatctaacataacagaagtaaatccaagttccagcgctttctgtaccgtttcaaatgtaagaccatgatccagatgaactgcaacatctactttcgcttcttttgcagcctgaaccatcattggtcccattagatgaagtggagaatgtttcagtcgcacctctgcaatctgaagaataatcggcgtatctaattcctccgctgcctgaattgcacctcgtaccatttccatatttccaacgctgaatgctccgcatccaatattatttttctgtgctctttcgagtaattctttcatttttacaagtgacataatcattctccttcctgacaaactgctgtctgacatgcatttactttttcttttttaatttctctctctaataaaattaaagaaatcaatgcgagtgctgcgctgaatgctccactagcaaatacagcgttgatgtcatatccatttccaagcacggtattggtaattgccggtgcacttagagttgccaccgcaataccaaacataacatatccataattttctccagaatgttccattccaaaaatagaactcgataaagatgggaaacttcccataattccaccataacaggcatacatcatcacaacgcatacagttgtaattcctgccggtgcaaataccaagagtaacattgcactcactgctaccaccaatactacttttacacagataactcttcctactttatccgccgctgtcggcagacaaagccttgtagctgcattacagaccgaacctgccataaccgccgcaactgcaactgaagcactgattcccctgtccatctgtaccgtctgtgacaatggagataaaatcagatatggaatcaaaccaaacatcatagttgcaagcaggaagtaaaatttctttgtgcggaacatttctccggatgtatactgttttcctgtgtacaccggctttccgcctgcctgtacactgcctgttccaacttcccctgtttttggatttcggataaagatacttgccaaaatccatgagattccaataaacgttccgattattaaaaatgttttttcaattccaactccagaaagcaaacttctcgaaaccggtgccatgaaaaatccaaacagaccgtttgccgttacaatcacacccgatgaaaatccggttcttcccggaaaccatttctgtgcggtagaaagaatggttgtataaatcattccctgtccaaatccctgtaacaatccatacgtgatatacatcatgaccggtgatggtctcagtgccagtgcacttaacaaaatactggctgtaaaaattgcaccgcccgatacgattgcaatctttggatttctcttatcctgaattcttcctcctacaatatttccgagtacaaatgtgacaaaactcagataaaaacacatcgatgtctgaccctggctccatccggttaactccattgcatacggctggtaaatcgaccagatatgtggataacctgtaaaaaaaatggcaaatgcaccaaataccagtatcagatattttgtaaccgctcctgtcctttcttttttcatagcttctccctcttctttttgataatattttgaatatcttttggttaattcttgattataaattatcatctttttggtaattcgtcaatagtcttttcaaaatttttaaattttgcttcacaagttactcaaaatattatacaataatactcacaaaacaactttttgaaagagggtttaatatgagaaccaaacgaattgacttaattgaacgttatatagaagaagaaaaactggtttccttagatgtactctgtgaaaaattcgctgtatccaaaaacaccatacgccgcgacattgaagaactggtcaaaaaaggcgtcgtagaaaaagtatacggaggtgtttcctttaaagtaccaccatccgataccccactcgttccttatgaaaaacgccacactgtcttaaatacagaaaaagataccatctcaaaaaaagccgcctcttttgtaaaagaaggcgacattatttacattgataccggaacaacctgcttaaatatggtcgattatctggcacatgttccatgtacaattattacaaacagcctgaggatttttatgaaagctgtacaatatccggatttgcagattatttctcttcccggcagactaaaccgtgatacattatcctttgtcggaagtgaaattccaacctatctgcgtacttacaacattacgaaagcatttatggcatctaccggagtcactattcaaaacggtctgaccaatgcctctgccgatgaatatgcaataaaaaaaacggtcgtagaaaacagccagacccgctttttactctccgaccatacaaaattcgggaaatttgcactcatgacttattgtccacttagtgaaattcaatatttgattacggatactacgccacaacagaaatatctggattactgtaaagaacatgaaattataatagaagtgacaaaataagtttcgtacagtgtaaattaagcagctgctatattgacaccgaacgattttctcctatacaggcagagaagtgagacgtagcggtgactacgacgattgacgaaaacgcattaaataaaaaacggctctcaatcacttgaaagccgttttctcagttcttatacaaactgattacatcctttatcataagtataatcaatattgcccaatttcttctctaattcgcttttgtccaaattcattgcctggcacatatcatctaaagaagaatagaaatctctcagtttcaaatttacaaaacttaacaaaatcattgggtctttcggtatcattttactttactccttcttcacgctttgcggtcaattctccattttctacgtctatgacgatggtatcttccgctcttacacttccggaaagaatcaattttgcggtcagtgtttccacatatttctgcagatatctcttcagaggacgagcgccgtataccgggtcatatccgccctcaataatatagtcttttgctgtatctgtcaagcgtaaagataattcctgatcttttaatctgcgattcaaatcagccacaagtaaatcaacaattccaccgatattctcttttgtcaatggcttgaacattataatttcatccagacgatttaaaaattccggtctgaaatgagcacgcagttctgcatctactttgtcccttgcatcctgactgatttcaccattttcttcgattccatccaacaagtaaggagaaccgatgttagatgtcataatcagaatcgtatttttaaagtctacggtacgtccctgtgaatctgtgatacgaccatcatccaatacctgtaacaatacattaaagacatcaggatgtgctttttcaatttcatcaaataaaactacggaatatggttttcttctgactgcttcggtcagctgaccaccttcttcgtatccaacgtatcctggaggcgctccaattaaacgagacacagaatatttctccatgtattcactcatatcgatacgcaccatgttctgctcatcatcaaacagcgttgccgccaaagtcttagccaattctgttttaccaacaccagttggaccaaggaacaggaatgaaccgattggttttgttgggtctttaattccggctttggaacgaataatggcatctgttacttttgtaaccccttcgtcctgtccaatgacacgtttatgcagttcctcttccagaccaaggatttttgttttttctccttcggtcagttttgctaccggaataccggtccatcttgaaataattcttgcaatttcgtcatcggttacactttcatgtaccagagataaatcctgatttttcactttttcttcttcgatttcaagctgtttttgcagctttggcatttctccgtactgcaatcttgctgcctcatcaagattataatctctctgcgctttctgaatttgtttattcatatcctcaatctgctcacgcagtttggataatttctcaacggaagctttttcattatcccactgggcttttcttccattaaattcatcacgcagttctgccatttctttctgcagttccaccagacgatcctgacttaaacggtcattttcttttttcagcgctgcttcctcgatttccatctgcatcagtttacgatttaactcatcaagttctgccggcatggaatcaagttcggttttaatcagagcacaggcttcatccaccaggtcaatcgctttatccggtaagaaacgatccgaaatataacggtttgataatgttgctgctgcaaccagggcgctgtctgtaatctttacgccatggaatacttcataacgctcttttaatccacgaagaattgaaatcgtatcttcgactgtcggttcatttaccataaccggctggaatcgtctttcaagagctgcatctttttcaatatactgacgatattcatcaagagtcgttgcaccaatacaatgcagttcacctcttgcaagcattggttttaacatatttccggcatccattgcaccttctgttttaccagcacctacaatcagatgaagttcatcgataaacagaatgatttttccttcactctttctgacttcttccagtaccgcttttaaacgttcctcaaattcaccacgatattttgcacctgcaaccagtgcgcccatatcaagggcaaaaatctttttatcttttaagccctccggaacatcaccttgtacaatacgctgtgctaatccttctactgctgctgttttaccaacaccaggttcaccaattaaaaccggattgtttttggtttttcttgaaagaatacgaatgacatttctgatttcggcatcacgaccgataactgggtcaagtttctgctgtcttgctttttctaccaaatcctgaccatatttatttaaggtatcataagttgcttccggattatcagaagtcactctctggtttcctcttactgtactcaatgcctgtaagaaacgttcccttgtaattccatattcctgccagaatgatttcatagtcggactcgggttatttaaaagagccaaaaataaatgttcaacagagacatattcatctcccatcgctttggcttcgtcctccgcactgaccagtgctttatttaaatactgaccaatatactgctgacctccggacacttttgttctggcatttaatgcctgttcaattcgattcaggaaatgctctttctgaatctccattttttcaatcagcttcagtatcaggctgtcctcctgatgcaccaggttgtaaaccagatgctcctgctcaatctcctgatttccaaattcataagcagtcttttccaaatcctgtactgcctgaagtgatttctgtgtaaatttgctaatgttcataaaaatccctccatctatatcaaaggctattgttttcttgttctattgcaaatataacactatttgttagcactgtcaagaggtgagtgctaattttttaatattttttttgcaaaccttgattttacgggtttgcaacaatttttctatctgcacctgttccttattaagcggcacttcagcaccattagtgccatcatttgcaccacaattaatgccaataacgccatttttggtgccattggtgtcaatcatggcgttattggtatcaacctaatctcgataagtattcatacgctctatcgtttcagttattggtaatttccaagagccttctctatatattcctgtcttaattcctctgccagatactcatcgctcatacaatgcatatcagaaacaccgtcacgaatcagctgataaacctgagaatgataaaggaaatccaacgccgcatccaatgaaagtccctgctgtttagcaaagcattcgataacacggctatattttttctggagcaaaatcggatttgctgtcatagtgtttcactcccttcaaaatacaacaaagacaatgatttctctgtacgaaaacaaatttgcaggtttggtttttcgtaacgcaaacggttgatcgcttctatcttatcaatcagtccgtcaaagaacagctccactgtattgaacaccttattattgacaacaccgcccactacaaggtcataatctgtcgaatcttttccactgcggcaattcaaaataaaatccaaccactcctcggaataggaatcaaatttcagtgttttcagttcggcttctctaccttcatcgtattcatactgggaaataataccatctttccctcggcgtttaaatttgccacaccacttcgctgcctgttcatacagcggcgtgacatagacctttcgctttcaatgtcagattcttgttcttgaaatggtgattactcattaccgtaaaattctttgttctctctacacgaaaaatctgtgccatgctcccatcctcttttttccgtttcgctacgcagcttataaccgggaatcttccagaattttcttacatcccctccccataaattacaacactgtagcctttctgctttttgctctgatacattgccccgtcagcctttctgtatagctgttcaaaagaagtctcttcatatccattataaaaacacgcaccaagacttatttctatactctttcccggcatctctatgacatcaatctgtcggatattttcaaaaagtcgttcaaaaaatttctcagctactgttcgctccaacattttcggcataaatattgcgaactcatcacctccaagccgcaaaaccacatcactgtcacgacatgttttccgtaacttctccgcaacagctataatcaccttatcccctacagaatgcccgtaagtgtcattgatggatttaaatttgtcacaatcgatcaggcaaaacaatcctcccgttttttcctttaaaagttcaataatccttttttctccgcttccacgattatataatcctgtcataagatctgtccgcgccagataaatcagcctgttctcacgctttttttcttcttctatacactcaatacagaaaagcacatgcagaagtcttccattttcatcgtagtctacaggaataaatctgcttcggcaccaacctgatattttatctataaattcatgtgttatgctgttttccccaagaagccgttcttccatcgtactgatatctagaaactccagtgattcctgaagttgtgattctatacatgttttctcagcaatatcattgatatatccgcaaaaatcatccctgactttatattctcccatttttttgaaatcttttcccaaacattccagaacctgatctgtcatttttacaatatgatatcttttggtctgcacatcaacccaatacatagatgtatagattttcgagagggatgaataactgctgagttttgcctctttatttgactttataaatgaattacgcaatttcagaaatgaaataagaagcgttcctatcatatccaaaaaagtagtaagccccctgtaatcactctttggaggattatccacaccaaaaaagccacttatctcatctttataacgcaaagggcataccaccacatttctcacattctgcgcttttaacatatcatacgatgcgcgatgttcttctttgatatcttctatatcagtgatactgatactttcgcccttggaaaacgtatcataccaccattttatcacatccatatcgacattctgcaatctgtctatctcaggaattactccttccgcgcaccattcatacgtattgtctgtgccgtgcctttctttacaatcctcaaaaatatatattctgtcagaaccgatatgtctgccgaaaaagcggataaattcattaatctgctcgtcaggtgtgtggtaattgagtgcagatctaagtgcttcatttatgaccagttcatactttatgattgtcttcatgttattttcctcctgaatgtctttcttatcttacttttttacattcaaaccagacggaaagaccttcttttattttctgctcttccacaggtttcataaaaaaatattctatccgaagcctgaacgcatgaagcgaaaaatcaaggtcactgcaccagatgattccacatttcggatacagggaacgaaggtgttctgctgcattcaggccggacactcccggtaatgcgagaaacaccactgtcggtactgttttcaatgtccgtgcaaaaaattgttcctgattctgataaatttcaatcaacggaaagacatgcttctctgtacagtaattcctgatatattccgcactgttttgtccttcctgttcctggtcggtcaatatggcaatacaatacacaatacccctccctttctatttcatgtactttcatttgttattctcattataagaaagccagaaattatttcaacaattctggcacgaattgacagaaaatggcacgaattgcaactccgtggtattgttttgtgctatactgttaccagagcgttttcgaaataactacaccacttgcctgtctgcggctatagattgcgcagatgaaaaagtctcagcaagcggaatttacttttgacactcacatcatttcataaatatatataaggaagagctactatgaaaattgcaatcgttgatgatatttcagacgaacggacactgctacgaaacagactggaatctcagttttccagacgcaatgtccatacagatatatttgaatatgaaaatggagaaactttcctcactacagcgaaagaatgccctttcactgtagtgtttctggatatttatatgaatggatccaatggaattgatacagcaaaagaacttcgcagatcagacactaactgtctgctgatctttacaacaagttcaactgaccatgctctagagggatttcaggttcgagctctgcactatcttgtaaatccctacagtgaaaatgatatttccgcactggcagatgaaatcctttctcgcatcccggattctgggaaatacatagatgtaaaggtaaacggcagtaatattcagattcccttccagaaaataatctatgctgaacatttttctcacatgattcacatccacactgccggtgaaagggaactgatcacccgccagtcctttgattccttcataacctccctgaaaatggattcacgtttctatcagtgtaaccgaggcgttgtaatcaatctggagcatgccgttgattttgacgactcaggttttcgccttgataatggaaacaatgtcccggtcagccggaagctgctcaaaaatgccagacagacatttatggaatttctgttccaaaggaggttctgaaatgactgacatacttcaacctgtacttgaactttccgtaatcattcccggcgtactgctagcatatctgcctgtaaaaagctatctaagacagacaccgcttaagctgacagcgtggcttcttcctcttcttctgggaatctgtattttcgggggagcagtttgctgtgccctccaccttcccaccagacggatcctgtttcctctgctgcctgttattatgcttatttatcataaaacattaaaaatctctgtctggaaatccgccagtatttttctggcagtctttgcagtttttgcatgtatcaacagtctttctcgggcagtcaatgcacttataactgctgacctgcctattacagaaaataagctgtggtttcgtaccggtgccggaattttctataacgtcatctgcctgctgtttgttctggcagcatggtatcctgtccgccactatgttcaaacaatgatcgcagacgaaaactttgcccagacctggtatgtattctggattcttccggtaatcttcatcggagtgaatctttttatgattcctaaataccgcggcactttatatactgggcgggtcctgcagtgttatattgttttaagtcttgtactgctcataatcctgctcctgttttatgtcatatttcttatgatggcagctagcctgaacagaaatgcccgacttcagcaggagaaccattttctttcccttcagcaggaaagatacgagaatctctgcatggccattgaagaggcaagacaggcgcgtcacgatatccgccatcattttgttcaactgtcctctctggcagagcagggtgacatggaaaaggtcaaaaaatatctctttgctgcaaccggaaaaatctctgactataacctccatttctgtgaaaatcaggctgttgacagtgttttcggatattattccacccttgccaaaagagaaaacattccttttcatgcactggtttccctgcctgctgatctttccatagatgagattaatctgtgccttgtattttccaatctgctggaaaatgccatccaggcaagtgtgaaaacagagcacgcccgcagaaagattaatgtggaagtttatcctcaccataatcatctgcttctgattcatgtggagaataccttcgatggcaaaatacagcaaaaaaacaatattttccaatcctccaagcgctccggaaacggcataggaatcgaatccgtccgccacattaccgataaaaacggcggtgcctgtgactttacctataaagatggtattttttctgcaaaaataatgctccgggtataatcagtaactgattatacccggagcatccacgactgccgcactttataagattattctctcattccaaccaacactttttaccttcaaacacaaatccataatgtctgatttcttttcgctcaaatccccgagcaaataattgtacataaaaattcctgatttttaattctttttgcgatttgcccgttccagataaagaaagaacccaatatttaaaataattcccacgattgtggatatcggtgctgccagaccaattttggtcaggcttgcatttggctgaatactcataaaataggccagtggcagacgtactaaaagcgtctggattaatccctgcgccataacccaaagcgttttattatttccattaaagtaaccaatcatactaaaaagcacagccgttacaattgtctctaatgcaaatcctttcaggtaatcataaccattttgaataaccgcagcatctgtcgagaaaaatcctgccagtacatcccctttaaacatgacaagcaaaaatacaacgcatccaactgcaagtcctacgccaattcctgtaaccatagatttctttgctctttttgtttttcctgctcctacattctgagaaacaaaagaagccatagactgcattaaagcacttggtacaagcattgcaaagtttacgattttgcaggcaactccatatccagaagaagcttccagaccaagtcggttaacaaaggcacataatgcaaggaaagaaagctgggttaaacattcctgaagtgccaatggtaatccgattttaaggaattttttacactgcggattaaatcggaaatcgctctttttaattgcaaatggaagctctttctttaatagaagaatcactgcaaatacaacgctgagtgcctgtgccataactgtcgcaactgctgcacctgctgcatctttatgtaatactgcaacaaaaaacaaatctccgattacatttacaatacatgcaaccaacacaaacaaaagtggagatttgctatctccaagacctctgaatattgcagacatcaggttataagctacaataaaaaagataccacttccgcaaattcgcacatactgagaggtcaaatcaactgcctctgccggtgcctgcattaaaacagaaatcggacgtgcaaaacataccataataataaataatccaattgaaatcagagcaaatacaacaactgcaccaccaataacagctccaatctgctgtggttttttctcacccagataccgtgcaatcaaaaccgtaatacccattgcaaactgaatcaccacaaatgtaaccagatttaaaacctgacttcctgtagaaactgcagaaagtcctgaagtcgaaccaaatcttccaactaccagcaagtcaactgctccataggctgcctgtaaaatcaaagctccaagtaccggcagcataaaaaatactaatttctttaaaatactcccttgtgtgaagtccgctttatcattcattctttatctctcctctcacacatcacctgataaaatttctcaattactgctatcatacaatctgcttcttcttccgaaatatctgccaaataaggagccagctcattaaaatatttctcattgtatttttcagatagcttctttcccttttccgtggcagataaatagataattcgtccatcctccggtgagactgtttttttgatatatcctttttcttccatttcttttaccgtccttgtaacaccgggtcttggaagatttaatttatcactgatatccgatattttcacctgaacttcttttttctctaaagctagaatcacgtccagataatgaatataagacggagcaactccatttggaagtgccggaagtaactcacggatacgttttgcctgataacaggcatctaacattcgcttaattttttctgttgtcatctctcactctcctttttaaattttagttaccgacgttaattaccattgataattatacagatattttcctcattgtcaattcatttttttgcttgcccgaaatttttctttgtgctactattttcttagaaatttttctaggaggaattttaagatgagcgatgtattagaacaaatgaaaaccagaagaagtgtcaaaaaatataaaccagatatggttccacaggaaatcattgacaaagtgaccgaagccggactttatgcggcaaatggaatgggccgtcaggctactattatcattcaggtaacaaacaaagaaatgcgtgacaaactctccgaactcaatcgtcaaatcggtggctggaaagaaggatttgacccattttatggtgcgcctgccgttttagttgttcttggaaaaaaagactgcccgactcatgtttatgatggcagccttgttatgggaaatttaatgcttgctgctcacgaactcggagttggaagctgctggattcaccgcgctaaagaagaatttgaaacagatttcggaaaagaactgttaaaatctcttggaattgaagacgaatatgaaggaatcggacattgtattcttggttatccagaaggagactacccggaaactccagaaagaaaagaaaatagagtatttacaattcaataatcattaagggtgtagaagcaacagactcctacaccctttttagtggatttttaaagcacattttgcaaaaaccaacagataaatggcaatgtgataatcgaacaaatcgtggtaataaataccccacccattgcgtaatctccatctgaacctgaagtatttgccatcatcaccaccgatgtcataaccggcatccctgcaatcaatgccattgttaactggatttccgatgaaacagaaaggaatcctaaaagaacaaacaacaaaattggtgccagtatcatttttgtaagcacgattccatatagtgcgaattcttttagatgttttccaatgtgaatacttgcaaaaattccacccacataaatcattgcaagcggtgacgccgttcctcctatcttttgaagtcccatatccagaatccgtggctctttgatttcagttaagaccagaaatactgcaagtaaaattgcaaccgttgccggattaactaatttcttcgggttaaattttccttctccttgcggagttgtaaattttactcccaaagtccaaagcataaactggtctattatcgtaaatactgaaatatataaaatgccatttttcggaaaaatgcttgtaataatcgggattcccataaatcccacatttccaaacatcgacattgcctgatagattcctgctctgtctcctttcaaatgaaataatttcgtcatgccaaatccgcaaaaaagcataaaaaaataaaagccggcagtaataaacagtatcaaaacagaatgaatcaatgtttctttttctactccatctgtgatatttacaaaaaccagaatcggtaacgccatttttactacaaatctggaaatggcttcaagcatttcactgcttaataccttcgctttgattaaaatcacgcctgccagcagataaataacaaacaaccccatctgttccagcaaaatttcaaatgtattcattttctcttttcctctcatttctttccctactaatctatcgcattttgctattttcgtcaaattggcctttgctatttttaccgagtttttgtatacttttcttatctataagacgtttttattctaaacaaggaggcatttttttatgaaggaatacgaaatttttatcgaaactatgaatccctgcggtggcgcaaaatatgccaaacaggaaatcatcgaagccgaagctgaaagcccggaagcttatatcaaagagcatgcgaaatatcctgttcttgagactattaaaaatgcggatggagataccgttgttacgacagggaataagaatgggtatttgattcggtatacgtttacggagtgaataaaaaaatcgtgaatcagctcttcccctgattcacgatttttcatttatttttttcctaaccaatacggttccatatatcctgcttcacaaagatttccaactccctgtcctagtccggcagaagacaccggagcttcaaaatcctgtgtatttccatctgagccaatatagcggatacattttgtttcgtcatttggagacatgtagaatcgatattcttcctgtcccttatagacaaaggcaaacaacagagtattattttcatagtaaaattcagcggaataatcctgaggcaaatccgataaagttccagaacaggctccattttgagagacaatcttttttagatttccattttctgtatagattgccagaccacttgtgctttcatctttattataattatttaacttgccttgcgtatcataataaacatcacggatatgctgaatcatttcctcctgtgtctgtccctgtgcatcccaggtacttgttgtctgatttggctttgttgtcgtatccgtagcctgattcgatgaagtggaagtctctgcattgctctgacttacttcttcagcttctttctttgcctcctctgcctctttagcttcctgctcctcatattttttccatagttctttttgttcttcttcctctttctttttttcctcttcttttttcttttcgtcttctgttttttcttcctctgctttcttcttttctacttcttcagactcttctttcttttcgtctttgcattcttctgttttgcttaccaactcttcctgctgctgcgcttcctgtttcttattttgaatcaccattccggttacaactgctcctgcacaagctgcaattgccagaatcgcaatcaatatatacagcccaatacgttttttctttttctcttctactaaagctgtaccacaaattttgcaaaatttctggttttcatcatactgctttttacattttggacaaatcttcattttctttctcttttcacctcaaatatttttacctataaaatacggctgtattatatcacaattttttcaaaaatcaaatctgttttcttttctttttctaccttataataaacttgctaaaattgacattcaagtagaaaggattttaatcatatggaacaatttctcgcaggttttgaggcattaaaagccaacatctttgataatatgattgaacaacaggctaaacttggttatcgtaaagaacctgtccgtctttactatccacttagctctctcaaccatttttttaataaaaaagcagactcagatgaaatgcagcagatactttcggattttccggtttatacaaaagaacaatgtggagaaatttctgccacacataaaggagaacgcttttgttttaccatctccgaagaggtttcggagtatgttcacacaaataaacccggcaatatttttatttgtgaattaatccagcttttaacaaagcatagtacaactcttgaagagataattacgcttttcaagtctcaaccaaaagaatccgttatcgaaccagtcaacaatggagaattcgacattttaattcgttttgtaaatgataaagaccgctattactattgttttaaagatgaaggttgccatattatctatcatcggttcttaccggaagattacgcagatttcgatttttaacaaaacaaaagagcaggagaacttcccattctcctgcccttttttaatttacagaattttttttatgcatctatctgatttaataagttcaccatttcaattgcagaaagtgcacagtcatatcctttatttcctgctttgcttccggctcttgcaatcgcctgttcaatattttctgtcgttactacgccaaataacaccggcactcctgtctgtaatccgactgttgcaattccttttgaaacttcattgcacacataatcataatggctggtatcgcctcgaataactgcaccgacacagataaccgcatcatactttccggattttgcaagacgctctgccacaagcggaatttcaaatgctcccggtacccatgcagctgtaatgttttcttcttctactccatgtcttaccagtccatctactgctccgccaagcagtttatttacaataatctcattaaaacgagctgctacaattgctgctttcattccttttttggctactacttttccttctaatacattgatttctttcatgattttttctcctttttgtatgcctatgattttattgttttccagctaaattaatttaaaatgttttgaaacacatgtcccatgcggatttttttggtttccatatagcgtctgtcatactgctgtgttggaatttcaattggcactctcttcttgatttcaagtccaagtccactcaatccgtaaatctttgttggattattggttaataatcgcatggatttaactccaagatcttttaaaatctgtgctccaacccagtattctctcaaatccggcgcaaatccaagtttaatattcgcatctaccgtatcatatccttgttcctgtaattcatacgcctttaacttgttaatcagaccaattccacgaccttcctgacgcatatataatacaattccgcgaccttctgcttctatcatctgcattgctttttggagctgaggtccacaatcacatctaagagagccaaacgcatcaccggtcagacattcggaatgaatccggcaaagcacatcttctccatccccgatgtcaccttttaccaatgcaacatgatgctcctttgtgatatcatttacataaccgtaaattttgaaatgtccatatcggttcggaaaatccgcacacgcttctcttaacacatgtttttcgtgaattcggcagtaatcctgaattgcctgaatcgtaataaattttaattcaaactttttggcaagctcccaaagttcacttgtgcgcatcatcgttccatcttctctcataatttcacaacacacaccgcattgttttaaccctgcaagacgcatcaaatctacagttgcttctgtatgtccatttctcaccagcacaccgccgtttttcgcaatcagcggaaatacatgccccggctttctgaaatcctctggcgaaacgttctcatccacacacatccgcatggtaagtccacgctctgctgcggaaatgcctgttgtcgtatctttatagtcaattgaaaccgtaaatgcagtctcatgattgtcggtattttttgttaccatcggtacaaatccaagtttttctgcaagttctacactcatcggagtacaaataagtccctttgcataactcgccataaaattaatattttcctgtgttgcaaactcggctgcgcaaatcatatcaccttcgttttctcgattttcatcatccgtaacaagcacaattttcccttgttttaagtcttctaacgcttcttccactgtgttatattcatgttccatttccgttttcctccctgtcagattccgtatttttctaaaaattccattgtcaaatttgaggatgactctgattttttctcttctgtttctttaaaattcaatagccgttccacatattttccaatcacgtcgttttcaatattgatacagcttcctgactttttatcagctaatgtcgtttcctgtctggtatgtggaattactgaaactttaaatgttacatcatttacttctgctactgtaagactgactccatcaagacacaccgagcctttttccacgataaattttagaatcggtgcatctgcttttattgtaaaccagactgcattttcttccggcaatatctctgtaatcacaccacagccatctacatgccccgacacaatatgtcctccaaaccttccatttgctgacatcgccctctccagatttactcttgcacctgtttttgcttcttttaaactgcttcgccttacggtttctgccataacatcagctgtaaaaaaaccatttccaagagtagtcacagtcagacagattccattgacggcaatgctgtctccgatttttgtgccttccaacactttttttgcctgtatttttatacttccggatgagccggaaatgcttaatttttgtatgatacctgtttcttctacaattcctgtaaacacttcggtacctccttccggtaagtaagctgtacgtcttctccaatttttctgatgtcctgcagataaaattcttttgcgtcttttacctcacagattccacatccttctacaggggaaggtgcaccttttccaccaaaaatctttggtgcaagaaatacatgaacttcattaaccagattttctctcagcatgctttcatttaatgtaccgccaccctcaagcaaaatactgtcaatcttttgttctcccagtatctctattaattttttcaaatcgactcttccttcttttgaaacttccagcacctgtactccaagcatttccaaatctgcttttttctcctgttcggcatcggcacaagctatgattgtcggatactcttttgcactttgacaaatcttactttctaaaggaatctgaagtttgctgtcacagataattcgtatcggacttttctttccttcgattcttgtatttaacatcgggtcatcttttaaaacggttccgattcctgccatgattgcagtatattgatgcctcatttcatgtacgatttttctcgattgttcggaagtaatccattttgattttccggtttttgttgcaatttttccgtccatcgtcattgcatatttcatcacaatataaggtcttttcatctgaataaaatgaaagaataccggatttaattcatcacattcttctctcataaaatcctcttctacctcaattccctgcgctcttaaaaaccggactccttttcctgcaaccaaaggattcgggtctcttgaaccaattactactttcttgattccagcttctgcaattgcttcggtacaaggcggctgttttccataatgacagcatggttcaagcgttacatatatcgttgcaccttctgctgattcttttaaatgtttaattgcattgcgctctgcatgcagttctccgtatttttcatgatatccttccccaatgatacgtccatctttcacaataaccgcgcccaccagcgggttgggacttgtccatccaactccttgctttgccagttcaatggctcttagcatatattcttttttctgcattttctttctcctaatcgaaaaaaatccctgcaaataaaaagtttatctacagggatttctcatatttctaactatatatgaaacaaaaaggctctgaaacggaaatccatttcagagcctgatattcatgattttgattttttaatcagtcattcatttctcttcttccatccagactttactgtcggtatcggaatttcaccgaatcatgcctttcaaatttattttttcaggctcgcagactatcactgccggtagggaatttcaccctgccctgaagatttttcttatttacttgattaaaattatagtacaacaatttaaatttgtaaagtgcaaattttaaatttcttccagcacaatttcaaaagagacatcatctccaaccgctctttgaagtaaaactcctccactcatcaaagcaacacctgtgtacacctcttctgttccggcaatcttataatttttcttagcttctaagcccattagacgcagagtctttcttaatacatttggtttcgcacggaacaatacaccctgaaccaatatggttttcttatcttctgatatccaggaccatgctgacatcccatcctcaaatggatttgccagacgataataatcaccgttataaatcaaactttgatattctttataatgggtaacctgttttgcaacaactgttttttcttcttctgaaagctgatttaagtctaattcatatccaaagcttcctgccattgcaaccacacctctggtttcaattgaggtaattcgtcctgtctgatggtttggcactgcggaaacatgagaacctactgttgaagttggatagaagaaacttgtaccatactggataaaggttctttcatgtgcgtcggtatcatcactgcaccaaatctgtgggcagtagtacatcattccggcatcaaatcttccgcctccgccactgcatccttcgaacaatacatccggaaattctgatgtcagtttttcaagcaattcatacagtcccagcacatatctgtgtggcatttccatctggcgtcctctggaaagtgtagctgtataccagtcactgatactgcggttcatatcccatttcacatattcaatatgattttctcttaaaatcgcactcattacaccataaagataatccaccacttctggatttgacatgtctaatactaactgataacggcttctcatcggctttcttcccggaatctgaatcgcccagtctggatgattacggtacaaatcactgtcctcggataccatttccggttcaaaccaaagtccgaatttcatacccattgcattgattttctcaaccagggcttttaatccgccatttaatttcttttcattgacaaaccagtctccaagtccggaacaatcatcatctctctttccaaaccaaccatcatcaagtaccatcatatcaattccaagcttagaagcctgtcttgcaatatttaaaatcttttcttcgttaaagtcaaagtaagttgcctcccagttattaatcaaaaccggacgactgcttaactggtatgttccacggcagacatgatttcggatgatgtgatggaaattctgagacaattttgcaaatcctgttgtagaacaagataaaatcacttccggtgtgtagaacgcttctccggcttctaaggtccattcaaatgtgtctggatggattcccataaccaaacgaacctgttctaactggtctttttctacctgtgcctgaaatcctccgctgtacatcaatgcagctccgatgcagtgaccatttgtctctgtacaatctttttcacaaagcagaacagccggattttgatgatgactggaagttcccctgctgctgctgctctctgaaattccgtgcaaaacaggaactcgttctgcctgtctttccatagtatgtctgccataaaaatgcatccattcccagtctccatacggaatatccagacacatactatgcactttattaattacaatcggtgttttccctgaattttttaccaccacacttcttgtaatcacgtcttctttttcaaacacaccatacttcaaaatcacctctgcttccgttgcagtatctttcaaagtaatttctaatgtttctgcttcgtcttcttttgcatacactgccggaagccctggaatctcatattttccttttttaatctgatattccctgactcttaagtctaaagcattacttccatcttcatgagtaacagaaattgcagagattcgaaaatctccaactccgctggtgctgtattcctgtggcagagtatttaaagaataggttctttcattttctgcttcatagatatttccggaaaatcctgcgtccggataatccagaagataatccatacaacaatctgttttttctccataccagagatgattgagtactccaaagcgatccaccttcatctgataaagtgtgttttctgtttccaggttaaaaattttgtcctttactgtaattgccatacgttttcctcctaaacaagatttttgttttcactgtttgctctcgtatcttactttctattttaaccttttacagctccatttgctaccccatttaagatttgtttctgacataataagtagaaaatcagaatcggaattaatgcaagaatgtaggatgcaaatgcaagattataattcgtaccaaactgggtctggaaattcagctgtgccagtggcagagtatttttcccggttcctgacataataacaagtggagtcattacgtcattccaggttccaagtgccgttaaaatcgcaacggtcgcatgcattggagacatcattgggaatataattttccagaatgtctgccaggtagttgccccatcgatagaagcagcttcttccagcgtttccggtatattttttaaatatcctgtgtataataaaatattcatcggcatatagaaaaccagataaagaagtatgacacctaaacggtttccaagtcccatctgtgcagtctgttttacaagaggcatcattaagattgcaaatggaacaaacataccgctgacaatgtaaagatatataaatcgaaaggcctttttatgtgccatacttctcccaataacgtaacctgcaatagaatgaactaaaattgcaagtccaattgtcacaagtgtaatgagtaaactatttcccagagagttccagaaatctgttactctcattgcttctttgaaattatccagactccagcttgatgggaatgccagtgcacctgccacatcatttgtcatttcacttggctttttaaacgcaataatcactgccatgtacagtggaaaaaatactgtaacggttcccaaaatcaggatagctgtcaaaatacgatttacttttcctgtttctttcattataattgctcctccttcttatttaagactgtcatctggaatacagaaattgcaacaatcacaacaaaaaataacactgcatttgcactctggaatccaaactgtccgccatccataccatttttgtaaatcaaataagaaatagattccgtactctgtgccggaccgccttttgttaaagacataatctggtcaaataccattaacaggttctttgtgctaagcaccagattgatagttacaaacggaataacaagcggaagggttacactgaaaaactctttccatttgcttgcaccatctaacatagatgcctcataaacttcctgtggaactgtctgaagccctgaaatgtagataatcgtattcatagcaactgcctgccatacaccaacaaccagcacaccaatccatgcatttttttcacttgccaaaatactgttttgaagccatccaatatgaagactggttccaattcccggaaggatgtaagtaaaaataaagctgaaaatataaccaattaccagtccgcctaaaatattcggaacaaagtaaattcctcttaaggcgctcttaaaacgaattttgctgtttaatcccagtgccagtaccagacttaaaaaatttaccagtattgttccaacaatcgcatatttaaaggtgaacagataactctttccaacacgtgcatcggtaaataaatcaatatagttacgaaatcctacatattcatacgttccatagcctttataattggtaaaactatagataaaaccttttatcatcggcaatgtattaaaggcaaagaacaaaattaaaaccggaataataattgcccagaacgttttatctttatttgtcattttcttcttcataacaatctgtcaaactcctctcttatttctgtttttcctgatagtcctgcattttccggattaaatcacggttgtatctctgccagtctgtatcaaaacgcttcaggaaagtatctaatgcattttcgctgtcatctaacaaataagtctgtaccatcgcatcgacactcatctcacttggataatggtggtcatggaaatccgccattcttccttcttcgatatagcttctcatatcttctaattccggtgccagttcaaaatcaccttctttacatgcaattccgccctgatcatctaaataaatctgaatggtttcatcttcatataaaaatcttaatacttcataagcagcttctttatttttactttctttcagaacagaaaactgtaaatcaattccggagtttaacacattgtctgcttccgaatcatttgccggaaatgtaaacgaaccgatattcatatctggatttactgatttaatctgaggaatcgcataacttccaatcggatacatggcggcttctcctcttgcaaatgcggtacatgcgtcattatatccatatgcatatggattcggttccgcataagaaaccagctctttgattttttctgctgtctctctataagcatcagaaaaagttgcttctcccttattaacctgactgcaaatatcagaatctgtcagtcctactgccagagcattccacggtgccatacaggtccaggtatctttaaaacctaaatataatggctgtactccacttgccgaaattgtctcacataaagttgtaaattcgctccatgtagttggaatcttccagccattttcttcaaacatatctttattgtataaaatacctgctgcatttgccgcatacggaagtgcataacttccttctgtcggaatcagcttcaactcttcttccatatccagataagcctgttttgtttctttgagtacatctaagtctgataaatcctcaaacaaccctgcatctaaaaaattagaatagttcatatctccaccaattcctacaatatccggatagtcttcacggataaatctggtttttaaaattgtaaccgcttcatttggtgattcaattgttaagtgaatatcatcatgcgtttcattaaaccgctcttcaattttttcaaaggctgccactgcctccggcttataagaaatcatctcgacttctgtttttccatcggatgttttatttccacatccactaagactgactgcaccaagcaatatgccgccaagtacaatgagccctcttgccatttttttctttgccattctgactctcctccctgttcttctcttttttcttcttttattttaacatagcaatatgctacctatgaatcgcccgattctgctatttttatacccaaatgatagattttctgttataataaaaaagcaatatcgcattttgatatatattaaaaaggagcatcttttttatgagtaccgtatcattttctatctttccaaatgacaattttattgacctgtgcctttaccagtatggaaaagaacaatgcgaccctggacattcttttggacccgctacacgaaatcactatctctttcattatgttctctctggcacaggcacgcttatggctgataattcaaaaggaatcacacagacttattccgtgaaaagcggtcagggatttctgatttttccagggcagatcaccacttattttgcagaccaggagcacccctgggaatatatctggctggaatttgatggactaaaagtaaaagaagcccttcagacaacttttttttctttagaacatcctgtttatcgtgcaaattcaaaagagcttcgggaaatcttaaagaatgaaatgctctatattgtggaacactgcacagcatccaaattccatttaattggacatctttatctcttccttgacgcactgactcagtccactcattctaatgaactgacttccagcagtaaaatgagtgattattatattaaagaggctattcattatatcgagcaaaactttcaaaatgacatcagcattgaagaaatcgccggggtctgtggaatcaatcgaagttattttggaaaaattttcaggaaatccattggaaaatcacctcaggaatttttgatgaattaccgaatgataaaagcaacggagcttttaagcctgacttctctttctatttcagaaatcagtcaggccgtcggatatgataatccgcttcacttttccagagcatttaaaaatgtttatggaatttctccaagaacctggagaaaagaaaataagtaaaaaaaacgtggcaaagtctcatctattcagactctgccacatttttttattgatgcgctgtctttgtaataatagaataatattccggtcttctatcccggaacagtccccattcaagccgttttgccgaaagctcatcaaggtcatattctttctctaaaatttcttctttatcccttgatgcgcttttaagaagctctcctgtctcatctgttaaaaaagaagaaccataaaaggttaaggaagaggtctgtcctccattctcttcacttggttctaccgtttccagaccaattcgatttgcagcaatcaccggcataagatttgcggctgaatgtccctgcatacaccttctccagtgcggcatactgtcacattccaaaatcggttccgaaccaattgctgtcggataaaataaaagttctgcgcctaaaagtgccatgcttcttgcagtttccggaaaccactggtcccagcagattccaattccaattgtgccaaatctggtttgaaagacacgaaacccggtatctccaggtgtaaaataaaatttttcctgataataatggtcatccggaatgtgagtcttccgataaacaccaagaatcgtcccatcggcatcaatacacgcaatagaattgtacagattattgacttctttttcataaaaactgattggaagcacaactcctaattctttcgccagacgctgtcccatcagaaccgcttcgttttcctctaacggtttagcataatgataaaaatcataacgacgctgttggcaaaagtattctctttcaaacagttccggaagcaaaattatatttgctccatctcctgctgcctttcgtatcattttttctgctttttttctgttttcttctggatttttactacactgcatctgaattgcagccactttcacctgtctcattcttctactctctttcttccttccggaatctgctgtgtaatacaatgaatatttccaccacccgtcaaaatatctcttgcatctactgcaatgatttctctttccgggcaaagtttcttcattatttcctgtgcacgaacatcactttctttgttttctcccccaaattccggcatcacaactgctccattggaaaaataaaaattcacataagaagccgccagacgttccccttcctctctgacgtcttctccttcttcaaaacaatatccttccaattcttcttttgtgacacaaatcggaacatccggtatcggcagcttatgaatgaccagttttcttccctttgcatcacattcagactccagataatccagacatgcttttgataaaacatactgtgggtcatcttcattatctgtccaggcaaggactacctcacccggctttaaaaatgcacatacattgtccacatgctcattggtttcatccaggtaaatccctcttggaagccacaaaattttctctgctccaagataagatttcaacttttcttcaatctgctttttacttaactccggatttcttcctttgcttaacagacagctcgccgtgaccaaaaccgttccttctccatccgaatgaatcgaaccgccttccagcacaaaaggagctgcgtcataacattcatagccctgccaggcagaaaacgcttttgcaaatgcattatcaagcttccacgaagcataaagcccatcgacttctccgccccatgcattaaattcccagttaactgcacgcaccattctttcatttgctttatctgataccacaaaagtaggaccgatatctcttgcccatgcatcatctgttttagcttcaaacacagtaaccggatacggaatctgctttctttttaattcatttgcaaagttcgttgcctctgccacatcttcttttcttgcagctaaaaagactgcttcactccttgcaatcgcctctatgaccgctgcaaatgctttttttgcttctcttgcctcgtttcgccaggaacccggtctgcttggccatatcagaatgcagcctttatgtacttcaaattctccaggcataaaaaatccatcttgttttggtgtctgcatcttaatctctccgtttttttcctttcaagactgcgtaaagcggacattcgcaatccgcttcgctacttgctcatgaacgcagtcgcttcgcgatctgtcagtgggagctttcaactcccactgacagaagcatcccccctcacccgccgcttagtgctctgcgcacttgaagctggggaatgcttatctgcattcaaaattttcacgataagcgtcctttaaaatcttcataagaaaattcttttactatttccacttctccattttctttttttaatgcaattgcagggagcggcatcccattaaaggtattattttttaccattgagtaaattgccatatcttcaaaaaccaaacggtctcctacctgaatcggtttttcaaagctataatctccaatcacatcacctgccagacaagtcatagaagagagtcgataggtataaggttcttcacccggctgatatccattttgaagtggcgggcgataaggcatctctaacacatccggcatatggcaggctgcagaagcatctaaaatcaaaatctgtatttcattttttacaatatccatcacttccgtcacaagataacctgcatttaaagcaaccgcttctcccggttccaaatatacttctacgtcatatttttcttttatcgagctaatcagttttttcaaactgtcaatttgataatccggtctggtaatatgatgtccaccgcctaaattcaaccacttcatctgttttaaataacagccaaatttttcttcaaatgctgcaaatgttctgaccaggtcatctgcattttgttcacataaagtatgaaaatgaagtccttcgattccatccagatattcttctttaaattcactttttactacgccaagtctggaaccgactccgcatgggtcataaatttcatgcccctcctgggtagaacactccggattcacccgaattccaacgctgacatttgattcttggcaaatcaatttatgtttttcatattgggaaaaagagttaaaaataatatggtcgcagatttttaccaattcttgcatatcttctgttttatacgcaggtgcaaacacatgattttcttttcccatttcttcccagccaagacgtgcctcataaagcccacttgcagtagtcccgcttaaatagtttccaatcatcggatacaatacaaacattgaaaacgctttttgcgccagtaacacatgtgcgccggtttcctcttccaatgcatgcagaatctcaagattctctcttaattttgcttcatccactacatagcatggagtgggaattgcttcccacctcatcgtaccacttccggattttcttcaactacccatggaagtccatactcattcaacatttccataaatgggtccggatcaaactcttcaatgttgaagacaccgtctttatcccaaattttatttacaatcatagcagcacctatcatagccggaacaccggttgtataagaaattgcctgagagccgacttctttataacattcctgatgatcacatacattataaatataaattgttttctcttttccatcttttttaccggtgaaaatacagccaatattggtttttccaaccgtacgtggtccaagggttgccggatccggaagcaacgcttttaaaaattgaatcggtacgatttcttttccttcaaattcaattggtgaagtagagagcattcctacattttccagacatttcatgtgagtcaggtaactctgtccaaatgtcataaagaaacgaattctttttactcccggaatattttttgccagagattcaatttcttcatggtgaagcagatacatatctttttctcctacctgcgggaaattatattctcttttaatttccatcggttttgtctctacccaatgaccattctcccaataagaaccgtttgcagagacttctcttaaattaatttccggattaaaattcgttgcaaacggatatccatggtctccgccattgcagtctaaaatatcaatggtctcaatttcatcaaaataatgtttcagggcataagcagaaaacacactggttactcccgggtcgaatccacttcctaacagtgcagtaatctttgcttctttaaatttttcctgataagcccactgccaggaataatcgaaatatgccgtaaatcctgcttctttacagcgtttttcataaatctctctccattctttgtcatccgtatcttccggctcatagttggcagtatcaatatagtctactttacatgcaagacaggcatccataattattaaatcctgatatggaagtgccacatttaaaacagcatccggctgatattcttttattaaagcaattacctcttctgtcttatccgcatctacctgcgcagttgtaatcacagtctctgttgttttctgaagtttttcttttaaagcatcacattttgactttgtacggcttgcaacacagatttcagaaaatgttttgctgttctggcagcattttgtaatcgcaacctgtgcaactccaccacatccgataattaataattttcccatttttctacctcctgagtgttttattgattaatttttttcttcctcttctaacatatcttccacatatttcggaagcataaatgctcctttatgcagattcgtcgtataataccaggtctgaatttttcgttctttccatttttttgcatctaaatgttccaacggatggtacattttagacgcaaacccaaacagccaatatccggaagaacacgtcggaatatgtgcctgatagacacgactgattggaaaactatgacttgcctttcgatgcattactcgacaagattcctcatcttcatcataaaaagggcttccgtgctgatacaccataataccgtcttctcttaaggcacgataacaattcccataaaattctttagtaaatagccctgcattatgcccgagcggatcaatggcatcattaataatcaaatcatattcattttgctttaaacgcaaaaattttaatccgtcttcataaaagatgcgtactctcttatcctcaagtccacatgcattatccgggaaaaattttttacaaacctccacaaaaaccttgtccggctctaccacatcaatttcttcaatttcctgatagtgccctaactctcttgctactccgccatctcctccaccgatcaccaatactttttttacgtttggatgtacggccattggcacatgtacgaccatttcgtcatagataaactcatcttgctctgtaaatacaatgcttccatcagcacttaaaaatcttccaaactcatccgattcaaagacatcaattcgctgaaaatcggtctgctgctcaaataactgtttctgtactttaaccgacaactttactttttctgtatgataatccgaaaaccaaagctccatcttctttttctccatttcagttcgatttagactaatacatttaagtactctacttctgaatccatggttccttgcatggaacagcctttttcctttgcatacataatatattcgataatttcttttgtaatgcgctctccgggagctaaaatcggaattcccggaggatagcacattacaaactcactgcagattctgccttctgttttctgaatcggaagcgattctttcttagaataaaatgcagtctgcggagacatgacaacggttggctctatatattccatacttggcatctcttccggctttttggaatacaatcgcttaatatccgcaagtgctccgactaagcgctcgatatcctgaatccggtctccgattgaaatataagcaagaatatttgcgacatctccaagttcaatttgaatatcatactcatcacgaagcaaatcgtatacttcaattcccgcaagcccgatatctcttgtatagattgatagctttgtcacatcaaaatcatacacactgcttccatttatcatatcttttccatatgcataatatccaccaatggaattaatttcttctcttgcatattctgccatctgacttacctttgcaaaagactctcgtcctcttagagcaagattccgtcttgaaatatcaagacttgaaatcaaaagataagacgcactcgttgtctgagttagattaattacctgactcacatattcccaattcacattttttccggtcaaaagaagagaactctgtgtcaggcttccccctgatttgtgcatcgaaacagaagccatatccgctcctgcatccatcgcacagacaggaagattctctccaaaataaagatgcgttccatgtgcttcatctactaaaacaagcatattatgtgcatgcgccagctttacaatcgcccgcaagtctgaacagattccataataagtcggattatttactaaaaccgcaactgcatccgggttttcttttatcgctttttctacttcaaaacgttccattccaagagaaatccccaaccggacatcccgctccggattgacgtaaaccggaattgccccacatagaaccaatgcattaataacacttttatgtacattcctcggtaaaatgattttatcccctgctttgcaacaagaaagtaccattccctgaacagaagaagtcgtacctcctaccataaaaaatgcatgctctgcacgaaatgcctccgctgcaagttcttccgcttcttttatgacagaaacaggatggcagagattatctaacggtttcatggaattcacatccaaactgacacatttttctcctaacaattctaccagttccggatttcctctgcctcttttatgtcccggcacatcaaatggaacgactctttttcttttcaaagtttccagtgcttcatacaccggtgcccgcatctgccgatgctcttctttgttatttcttctgttatatttcatttctcctccgatgttgtgtcattccctctccaaaaatagaacgcaatttcctgtaaagtaagcaaaaaaaggacaggtaattccatcacctgtcctgtagtatcattctacaaaagtcattttaagtttatacactatgcatccttatgcatatttgcaaaaaccattttctttcagagcttatcgttgacgcttccgccagcaaatatttgctaaaactactcttattgaccgtttcacaagtgatatctctatctgagagggtcgcaggttactctcctgcacacaacttataaaatttgagcttctaactcaatcaataatgcggtctttcaccgcagtcggcagctgccccgcctgtccgtatgggcttaaccaatttcttggtgggcaaatatttgcatgaaaacaattttcgcattcatgtattttttagtataacataggttttttttaattgcaagaaatcttttatctggttaacttccgaatccactttccataattcacgatcaaaaatgccgggatacatttaaaccactgatccgcatttaaacagcacactacaatttgcggtgacgccttgaacacaaacgctgcaaggaaagaaatcggaagcacaatcccccagatactgataatatcaatctttgctacaatctgaggacttccgccgcctcttataattccattattggtcggcatctgataagacattcctacacagacggcacttaaaataataagaaaactgttcgccatcgctcttgtctcttcggataaattataaattccaagaattggaattcgcaagaaatataaggtaaccccggaacaaattccaattgctaaaaacagcttttggagttgcttggaataccgaatcacttgcacttcatctccctctccaactgcttttccaatgataacagaagctgtggagcacgcaccgactgctgctgatttcactaaaagaaacaggttggaggcaacactgttggccgcaattgcacgtgcagtcatatgacctaaaattgcagtttgaagtgcagtattgattccccaaaggctttgtaccaagaacatcgggcgtgttacttttccatagtctgcaaggatttctcgatccatttgctgaaagtaatcccggaatttcaaatctaagatcttttcttttcttatactataaaaaataacaattccacattctaagattcgagcgaccaaagttccaattgctgcacctgtcacaccaagcctcggcgcaccaaaccttccgaaaatcaaagtataattaattccataattaactactaacgtaacaatcgataacatcaaagcaatttttaccacctgaacggtacgaagagtagcaagcaaaattgtcgtaactgcaaaaaacagatacgtaaaccgaatgatggaaagatacacacagccttcctttacaattgcagtctctgttgtaaaaatatgcattaccgatactggcaaaaaggtcacaattccaaacaaaatcaaggcaattccaatcccaaaacgcattgcaacattgccgatttttttaattgaaccggtatcctttttgccaaaatattggctgcctaaaatgacggcaccttcagcaaatgcggataacatctgctgaaatataaactggatttgattgaccgctgtgacaccggataatgagatttcgctgtaagcgcccagcatgatattatctgtcaagttgacactaagcgttaacacattttgaagcactaataaaatataaattgaaagaaaatttttgtaaaagccccgctttttcatggttctttcttctcccgaatctcctcttcccatttatgtaattttcttgccgcttccggattttgcttttccagtctcttttcaagtctttccctgctcttcttcaagtgctccacaatctctggatgatgaatcaataactgctgctcaattttacgtcttcgtttttcaatcaattgcagaattactttgcgatctcctcttaagttttccggaagttcatctaaatgcaattccattcttcttaatatttcatcctcatcaattgctccaagcgaatgccagtttttaagtttttcttcaattccaagctctgcaaggcgctccaaatccggcagtttatgcagctgttccatcacctgatgcactttcttttcaatttcttctactgcatcatcaccaaaggcccaggcaaattcttctaaggtattttcctcttctgccggtatcattgcctcatggactgcatgcaccttttccgaaatttcaagcggacatggagaaggaattccggcatcatgcaaagctgcaagaatggttcggcggacttttccttcttcaattaaatgtccaattccaaggcttctcatctgttcatttacattttcggaatgttctgtgacataaaaatgaattccctgtttgtcaaagttttttgctatcatttccagacgatctgccgctgtgatatctatactgttgattgctcctgcatctacaatgactacttttgtatcttctttgatgctgctttcaatatcggactggaaaatcttaatgtttgcaaaaaacagattttcgctgaatcgataaataattgtatttttaatcggataagcattgcggtttcgttttaaatcataataggcttccttgcctggaatcataccataaaaagcacgaggcggattggttgctcgtaacacaactgctataaaagaaagtaacaatccgattacaacaccataaatggttcccaaaaacaaaacactgatgcacgctgctacaaatatataaaattcattccgacttactttaaataagcgaattgccagatgcaattccaccacattcataagtgctgaaatcacaatcgcagttaacaccggcacaggaagataaccgataaagccggttgcacagactaaaacaactgccatcactgcacctgctgtaattgaaactgcctgtgttttcccttcatactgctcattcattgaagttcttgaaatacttccattgaccggacagcatcccacacatgccgatgcaagatttcctgctgcgcacgccagaatttctttattttcattaattttatagccattttttaaggcaaagttattttctgataataaggtttctgacatgataaccgcagctatcatcagacttctccctgccgcctgcgtccagtcaatccctgcaaattgaaacatatgaatttttggaaggccactctctactgcatcaagcaaaatcactcctcgttcatccacatgaaacagcaacgttactactactccaaccgccataatcacaattgccatcggaaatttcggaatcagtttcccagccagccgaagaaaaaccaacgctccgactccaagtgcaactgacaaccagttaatttccttacaggtttcaaaaatatggtgagcaagttccggtaattctcctgaacccgccttacctcctaatatctttggtatctgcattaaaataattgtaagcgcaattccgctgataaatccccccataaccggtgttgaaataaaatctacaatcctgccggcttttagaaaataaaacaacaacagccatagtccggttaaaagcgcaatcacaggcacatactgcattgcctctttgcttccactctcaatcccaagtgaaacaagtgcggctcccacaatcgctgccggtgcagcatctacaccaaagataaactgttttgaagtagaaaacagtgcaaagaataaaatcggaaagaccgaaccataaagtccataaactgccggaagtcctgcaatttgtgcatatcccatcgaaatcggaatcgacaccgctgccataataattcctgaaaaaatatctttttttaagtattcttttttataattttttaatgtcggaaataataaacccttcatacgtttcattccttattattttgccatttcatagattgccagcatatctgcctcatataatacttttgcagagcccttatgtccgcctgtatttaaactgcatttatgtgccagttcttttaattcttcttcactcggagtcagccccagctcacgaagattggtcggcatctttatttcacggaaaaatgcctccattgcttcaattccacgcatcgccatctcttctgcatctccggtatcttcaagtcccattacccgcactgcaaatttgtggaaacgctctggaatttctctatagacatatctggcccagcttccccaaagtgctgcaagtcctgctccatgtgccacatcatacataccgccaagttcatgttccagtgcatgtgttgcaaaatcatttccaccgtttccacatccggttaagccgttatgagaaagacttcctgcccacattacttcagctctggcattgtaatcttttggattttcttttaagatctttgtattttcaatcactgtacgcatcaatgcttcggcaatgctgtctgtcagctccatattttcccctttggtaaaataacgctccattgtatgcattaaaatgtcggtgcatccgcatgcagtctgataatccggcagcgtcatagtcagttccggattcataatcgcaaacttcggacggcagtattcactgtgatatccggttttaatccatccatcttcatttgtgataacagaagaatcactcatctcacttcctgttgctgaaatggttaaaataacaccgattggcagacagcctgccgcacttcttttatgagaataaaaatcccatacatcaccaccatttgcaactccatatccgattgcctttgcagagtcaatgacacttcctccgccgactgccaggataaaatcaacaccttcttttttgcatagttcaattccttcctttacaagcgaaagtcttggattcggaaccactccgcccagttctgtatatgcaaggttttctttttccaatgcctgttttacgcggtctaacaatcccgtccgttttacacttccacttccgtaatgaatcaaaacttttttacagttttgtgcctttacaagttctcctgtcttttcttctgtgtcttttccaaatactacctgtgtgggtgcataataattaaagtgaaacatcctctgatcctcctgttattttcttactttttgagttattataagtataatacctgtgttttcagaatacaagttgactttacatttctattgtgataatctttttacgatttaagtagaaacaatacgggagcttgtgtgacaggctgagaggaagatattagcttcgaccgcacctgatttggataataccagcgtaggaaatcataagaatttataattttaaccatatctgctccggatttccaaatccagggcatttttactttattcaaaaaatttttataaataaagaaaggatacgctttatgaaaacagaacattctcacttacttcgcatggttatgcttgccatgttagttgccatcggtgttgtcatctctccgattctaagaatcgaaggaatgtgtccgactgcacattttattaacattgtctgctccgtgcttcttggaccttggtattcccttctatgcgcaactttaatcggaatcatccgtatgatgatgatgggaattcctccgcttgccttaaccggagccgtatttggagcatttttatccggtgtcttttatcgggcttccggtggtaaaatcatctgcgctgtcttaggtgaaatctttggaaccggaattatcggttctctggtttcttaccctgttatggcaattcttatgggaagaggcggtttaaccgcattttactataccccaatgtttttagctgctacgacaatgggcggaacagttgcctggttcttcttaaaaaccttaagtcaggcaggtgttcttgccgagtttcaaagaaatcttggagcaaaagtttatgataaaaaagttagaaaatctaaaagaacaaaatcgactcactaaacccctgattcactgcattaccaatccaatttccatccatgactgtgcaaatattgttcttgcctccggcgcacgcccgattatggcagaacacccgcttgaagtcgctgaaattacaagcaccgcacaggttcttgctttaaatcttggaaatattaccgatgcaagaatggaagccatgccgattgcattaaagactgcggtacaaaaagaaattccggtgcttcttgaccttgtcggcactgcatgcagtacgcttcgaaaaaattttgcaaaagaattactggaaattcatgttccttctgttttaaagggaaatatgtcagaactgcttgccatgatagaggaagaatcccacgctgtcggaatcgacgccggagaaaaagattccatcaccgacgaaaatcgaaatagactgaccaaactctttcggaaaaaagccgatgaatggaatacagtttttctcatcaccggaaaagaagacatgattgtatcaaaatatgagtgtttctttgtccaaaatggttcacccgctatggcaaatattactggaaccggctgtatgcttgggatggtctgtgcttcctatcttgcttctgcctcaaatgcttttaacgctgctctgacttcgactgttgaatttggaattgccggagaactcgctgcgaaaaagacaatggctcctgggtcttttcaggttcagctattggattccttctatcagttgaccgaagcaaaacgagattcacttgcaaaaacaatcgtgtattaataaaaagaggagacttttggtctcctcgaataatgattacagctctattttccgatctttgaaataatattccttgtcatgctcattgatttctcttatcaccttacacggtattccataagcaaccacatttgccggaatatctttggttactacacttccggcaccaattactgtattgtctccaattgttactcccggcattacacagacaccgctcccaagccagcagtttcttccgatatgaattggcatattatactgataagcctgcttgcgaagttccggtaaaatcggatgtcccgctgtcgcaagtgtaacatttggtccaaacatggtataatctccaacatagatatgggtgtcatctactgcagtaaagttaaaatttgcatacacattatttccaaaatgaacatgacgaccaccaaagtttgcatgaaatggtggttcaatataacagttttcgccaagttccgcaaacatctcttttaacatctgctgacgtttttctccctctgacgggcgggtctgattaaactcatacaagcgttcctgacatttttcctgttcttttaagatttcctcgtcccctggaagatacaattctcctgtatgcatcttatctttcattgccataaaaaatctgtcctttcgtttatctgcttttattataagagaacggcatacaaaaaacaatttatttctcttttatttttctgctgttaaaatctcgcacagtgctccaaacattgccggctctaattccattgaagctaatgttgcaatcgctcctttttgctgttctttgataagattatacaaatctgattttaaattataagaaatctgtgctttttctaaaatctcataagcttcctgggcaaggtctgccaaactttcttcgactggattttcaaatactacttttatctctgcatttaccggcacttctgttatttctatacacataccatttttctctactgttgctttatatgccgtctcttttccatctaccagcacgcttactgtatttttcttcatttttacaaaatccaatttccagcatcgtttttctggaagtaccttggtatttccctgtggactgtgaatgataaagcagtctttcccttcttcctgtgctttttccagctttgtttctacccagctttcttctacacagtctccttcatcttcccataacgtaaaacttccagtctttccagggaaaatttttatttccaaagattttggattatccgtgtcattatcaaatacttccatatttttcagtggaacaattgcaccttctcttgccagtaccggaatttcttcgattccacggaacaactgaaccatacgtccaccctcatattttcttccattaaaaaagtcataccagactccggacggaagccatgtctttgcttttccaagctgagtttttgtatctattttctctgtaatcggagaaaccataagttcactgccaaaataataattattcggtacctgataagcttcttctctctccggctctaaataatacattggcataacaagcggtttgccctctttattggcacagtaattcatggtatacagatacggaacaagcgcatgtcgcagttttaagaacgctttcataacagattctacaatcttattatatttccatggctcttttccattaaacggattatccgtactatgcagacggttaatcggagaaaatacaccaagctgtacccatcttgcggtcagttcatcatcacgatatcccatcatatgacctccgatatcatgactccaccagccataaccaatattgctcgcatttgctgtaaaatacggctgaaactgaagactttcccaggtaatcaccgtatcccctgaaaatccaatcggataacggtggcttccaggtcctgcatatctggaaaatgtcagcggtcttgtgcctttccatttattatccagataatgataatgattgagcatccacaacgggtcaagtcccggaacttttgttaccgttccctgctgccagtctacccaccagaaatcaacaccctcttcttccatcggatgatgtaattcttcaaaatatacttccataaatttcgggtctgtcacatcaaacaataccggttctttcttttccggatccattcccatctttgttgcaactctctcataagcatcctcataagcacggattccatctgccggatgtacatttaatgtaattttcatgtgatgctcatgcagccatcccataaattccttcggatttgggaaaaatttcttattccaggtatagcctgtccagccacttccataaatcgggtctacatcatctaccagatgccagtccatatccacaaccgccacggaaaatggaatttcttctctttcaaaccgctcaattaattctttatattcggtttctgtatagcgatgataacgactccaccagtttccaaatgtatatcttggaagtaatggtgtctctccacataaataatagaaatctttcagacattccagataacggtgtccatatccaaagaaataaatatctttcttgtttccgactctaggctccactgttccatctgacttcaatgccattgtcttagaatcatcaattaaggaaaatccattttttgataaaattccatgttctaatggaatggctccatctgcttcatctaacgtacgagcagttccaagcaaatctcttggggcttctccataatgccacactctttcattggattttcctccggctacacgaatcattaagcctcccggagtaaactctttcttatcataatgaatttctaaatcttttgtgtaaatatgaagttcgccatttacatcacttactttaaattctgtcggtgcaaaatcacgattcactaccatctgtgtcggacggtcttcaaattctccattttcactatattctaagcgtactaacgcagtggtcaacattgaaattcgataatgttcaccgcttactacatttgccgcacagcacattggatttccatttaatacatatttttccaatcccattttcattcgctccttattatttaaacctttttcgtttaagtttattataatgcaattttttttaagatgctttcaaaaattttacttaaaactttactattttgacttttttattctattatatattttccagtcaactactcgtcacctaaaggcagtgagtttccacttgcaacacgcaaaaaattttttatttatgaatcaaaaaagagatttatacaaacgaatgtataaatcccttttctatctctcaatctatgtatttttcttactctacaatacgtctgactgcaatgtatggtctgtaaagcgcattagatgaatatttaattccgccctgtggatatggtttgctgttggaagcatgtacaattccgccgtctccggtaaggattgctacatgtccggaatatacaatgatatctccggcacgggattcagaataggtaattcctcttcctgaaccagcctgtgcatcactggtacgtggcaggctgtatccaaagtgtgcaaatacctgctgtacaaatccagaacagtcaattccgtttgttaagctgtttccaccatagacatacggatttccgataaactggcttgcataagaaacgactgcatctccacttgcactggaagtacttcctgaagaagttgtagtctcttcttcataagtttcatctactgtagtattttcttccggtacaattgttgtttcagttgttgtattagaagcacctgtattagaggactggcttccagaagcactgcttgtattagaagagctgttgctcttacttgtgcttgcagctttctttgcagcctctgcttttgctgctgcggcagcttctgcggctttcttcttagcagcttcttcggcagcttttgcttcagcggcttttcttgcctcttctgcttttcttgcttcttcttcctgtattttcttcagttctgcattctgctgttcaattaattttctatattcagcagcctgagcttttacttcagaaatctgattttcatagtcagaagctgttgcttttttcttttccagttcgttttccagattttcctgctgctcttcctgagcctgtttcatctgttctaactcgcctttttcttcttctaactgatttccaagagatgttacctgttctacaacatttttcattttagagagttcatctctgtcaaactgatacatcttttctgtgtactctgctttacttaataagtctgtgatattgctggactctaaaagcatctgtgcccatgcaccacttccaccattctcataaagatactgaattctttttttcatggctgcgtactgttcatcacgctctgcttcagattctgcaagtttttcttttgtttcttctatagaatcttctttatctgaaatctcaccttttaagatttcaatttctgccagtgtttttaccagactctggtcaagagaattaatttctcctaataattcttctttctgttgttccagttctgcttctttgctttccgctgcagataatttactttctgtatttgctttttcagtctgaacttcctcttttctggatgcagctaccggcataacctgtgtgactgcaagagcaaaaataagactgagacaaagaaatctttttttcatatatattatgtacctcacattttctttctgagacaatattaccttgaacatgatatcacaaaattattacattagcaagcataactttaaatttttgtaacaaataagaggtcctgtacaattttgtacaagaccccttttgtcttttgttcgctttttaattctcttaaagtaagattactctacaattcttctgattgctatgtatggacgatacagtgcgttagatgaatacttaattccaccctgtggatatggtgcactgttagaagcatgtacaattccaccgtctcctgtaagaattgctacatgtccggaatatacaatgatatctccggcacgggattcggaataagaaattcctcttcctgctcccgcctgagcatcgctgacacgtggtaaactgtatccaaagtgtgcaaatacctgctgtacaaatccagaacagtcaattccgtttgttaagctgtttccaccatagacatacggatttccaataaactggcttgcataagcaacaactgcttctccagttgcactggaagtactgcttgagctattatctgttgtactggagctgtcatcggatacatcttcagaataattgctgtcattatcggatgtatcgttagatgcatcatttgttgtgtcattagatgcatcatcatttgaagtatcttcagaaacattgctgttatctgttgtatcttcggaagcactgttactgctattgtctgttgtatcttcggaagcactgttactgctgttgtctgttgtatcttcggaaacattattgtcactgttatctgttgtatcttcggattttgtacttgtctgttctgcttttgtgctttcagctgctgctttttcttccgcagcttttgcttcggctgctgcctgttcttttgctgctttctctttcgctgctttttctgctgccgctttttctgcagcctttcttgcttcttctgctgctcttgcttcttcttcctgaatcttcttcagttctgcattctgctgttcaatcaggtttttgtattcctgagcctgagcctgtacatttgcaatctgagtttcgtaatcggaagcttctgctttcttctgatccatctgcgtctgcagagaactctgctggtcttcctgagcctgcttcatatcttcaagctctgctttttcctgtgtaagctgttctccaagctgtgtaacttctgttacaacatctttcatcttctgcagctcatcgcggtcatactgatacattttttcagtatactcggctttatcaaacatatccgtaatacttccggattccagaatcatctgtgcccaggcattactgccaccgttttcatacagatactgtattcttttcttcatagatgcatactgtttatctttctcagcctgtgcatcctctaatttctgttttgtatcttcaattgcagattccttgtcagaaatttctccgtttaagatttcaatctgagccatcgtctgtaccagactctgatccagagaatcaatttctccaagtaatgcatttttttctgattctaattcatcggccttactttctgccgcagataatttactttctgttgctgctttctcagcctgtacctcatcttttcttgctgctgcaactggaaaagtaagagatgctgacatcgctaaaactaagctaagagctataattcgttttttcacttctttacctctctcctttttttgtgcttcactgttgtccataatagcacacttcttttaaagatgcaagcttttttcattttttattaattttcatgttatattttgtaacattttattaatatttaactccttttcttgtgcttatttttttagacaaccttactcttttttgttgtcttcacaacgttttttatggtattataaactcatcataaaagggggttcttgcgtgaacataaaaaagaaattaaatgaaatcatctacacaatctcacgctacacggaaatatttctatctctcattattctgaccgtgattgttctactgattattcccgtcgtatatgattttgtacaacatcctctgcttgaaatcacggctcacgatttcaccacatttctggggaatgtcctcaccttactcatcggtgtagagtttgtaaaaatgcttgcaaaacacaccgccgaaacacttctcgaagtgctgatgtttgctcttgcacgacagatggtcgtcgttcacgaaacaatgatcgatacgcttatcggaatcgttgcgcttggagcaatttttgcaattcgtaagtatttattattgaaaactccggacaagcagaaaatttatgacaaactttaaaaagaatctcgcttgcgagattctccgcctgcggcggatcgcttttgcgacagatttcctcaccgccgcagtgcgctccctgcggagtgtttttatttcataggatgcaatttcctatgaaacaaaaagccaccctgccttagggtggttttttattcataagctctcattcccggaaacaaaatgccatctccgtcaggatgagattttgcccgcatctgtctttctgtcagcatataatactgatatcttcttccattttctctttctcgcaaatcccaggtaacgtcgcagaaaaagtgctggtctcctaatttgactacattccacgcatgagttttagaagcatagccaaaacattcgatctggagctgtcttagcaagtaaagaaatgttactgagattccttcgcagacaccgacacgattcaataatgtttctagcgtgtaagaagcataaggataagaattatcattctgatatttcttgtttgtatacgtcaaatttaaagtaagaaaatcatagacggcacgaaccatctctgcttccgtcattccttttgtaataatctgctccaaaatatcttttgccattgccgacatctgattcatttttcttcgaatcaaatctctgtcgttataatgataactcatttcaaaggaaaaaactgttccgtcttcattttgctgaacccgttttatttcatactgattccaatagaaaaattccggaaaatctaatgcaattgctaaaaagacggccgaccagtctctttttgtcataacggtgcatgggataacctctttttctaatctggaaatcgattttacgaactgccagtaaaactcctgctgtcttcctgttaactgattaacacagcgcaatgaagtgctgtgttccatcttatcaatttttacaatttcctctgtcattttttgctcctttcatcccctgtttttttaatataccaaatatgtactctcaaagtctttcctgcatttctttactccaaattcattttttcactccaagtttagcttaaatccaacatgacatctactttctgattcattcctttttctaatgcttttacctgaattttgtctgctgtttccataatcagttccacttcaatagtcgtgtattttgcaagtggttttttacttcttaagagacaggttccaacttcctgtgccccttccaatttcatttttgtactgatactgccacttgaatacagatgcagtgcaacttttgtctgtttctcataagcagtttttacgtttgttttaatatgtaccggaagctccatatttttgaaaatcaagttttcgacgtgataactttttgttcctgcaccagaaccatctaaaattctaagaccaagtgtctcattcgacacctgcttcattttcgggattttggaatgactacctgactgattttctgaataaatcaagcctttcataatccctttttccaacatgtaagcatagactgcatccccaagtgctacggcttcttttgatttgtaagagatacaattgtttccatacatctttttaaattcattcacaaagtatggatttacattacttccccctactaaaagagtcaggtctgcactcactcctttttctttttccacctttgccagacgttccaagacaggcattaattttacctgcatcaatttttcacaaagcttatggtaatctgcttttgagattccgatttcaacctgtttattatattttggagtgtaaagaataatactatcgtactcttttcctggggcagacatacggattttacattcttcacaacggtttcttaacacctgaaatgcctctttatccccagagagatcgattccattcgcttttaactgtgctgtaaaatacgccatcatcagataatcgatatcgtctcctcctgcttttactccgtccactgccagcactttaatctgacgttttgaggcagataacaaagccacatcaaatgtacctgcacccaaatcaatgattcttaaattgagcgatttctcagataacttgtctggatacagatatgcaagtgcacaagcctccggttctgtgatcataccagccaccttcattcctgcactctgcgctgctctgcgcacaaattccttttgttttagattaaaagaagccggataagaaacaacacatttatctgtacgataattcagttttccatcaggatccattctggtctttgtatttcttttcaagtactgaaataatactttatgagcgtccaaaatcgagaaacgtaccccttcacggctgattgcaaatccattattttccgtgccaatcaatgatttcatagataaaacaaccggctcaagcatggctctttccttggcactgcgtcccacatctgaaaattctaatggttctcttaagagaacagcagaaggggtgctgttcactccctcttcattttcaattactaaaggtttttcaattttcgtgttatagactcctactacgctgttattcgtaccaaagtcaattcctatcgttttcgctgcgtattcttcaaacatcgtcagtctcctcctgtatatttatatcctgccaccatttcttttaacaaaatctttccatgatattcataaccatttctaattgattttgcaattctggcatgtttctcttcttcctctgtctccacaatatcaattacttcatgaatttttgaatcaaaagcagaattttcctttgttgtatgaattttaacccccatctcttcgaaaatagagtcaagccgtttaaaaatcagatgactctgttcttcctgttcatttgcggtcagataagaggctacatcttctctccataaagcaagctctcttaaaaacttttcgaaatcttccccttctctctgcttcgcatttaaaagtccgataaattcctgcaatatttcactctgactttcgattttacgattctgtgagtctattttttcattcattttctttaacagattttccatctggcgatactggattcttttattcatcttcatcctcctctgtgttgtcaaacttagtcaagtggatattcgcaatccgcttcgctacttgctcataaccaaatagctgctacgcagcttatcagaaggggcttgccccctcctgatacaagcaagtccccacccctgcttattgcttttcgcaattgaagcaggggacttacttgatttggttaaaatgttccatatattcatcctggtttgcttttactaatttgtctcttttagacttctttaaagggattttcattgtattcaaatactcatccatcacaactttttcgtaatatttcatttttctctgttcttcttccattttgctcgataagaacttcattacttttgccatatcataaggtgccggcaataaaccatcttctttccacatcaaactataatactcatcttgatgatactcgtaagcaaataataataactttgcaaagcactgtgttttaccatcttctggctttccaatcaaagaaaccgcaatggaatatccaaacaatctttctcttaactcattctgaaactcaaaccattcatcctctttgtcctgataataattgcgaattttagagaataaaaaacttggatttgcgctgttttcaagatactcccagcattcttctgcaaattcttctggttttttatcctgtttcttatctgattctctggttttaatttctgttttctcctgaccagataatttatattcaaaagtttttgcttgtaaagaagtctgaatcattcctttttctcttaagagattccaaattttcggaaaataaattttcagcatattttcagcagctgtacattttttctcagggtttctataaatttcccatagattttcatacagcgtaaacaaaattttttctgtcactcctaacacatcttctccagcttcttttataatctgataagtaaactcataaattttctttcgctctttccaatccaatcctaaaactgtttttacggttcctggaatccacatagattcccatttcttttctccgtttttatattccgtttttcctccaattaaaatttgtgctttcgactgaaggcatgttccattactgatagtataaagatgttcctgaagctcataaggcagaatctgatagtactcaagctgtacttttcttcgttccggctctgatccttcaaatttaaaatagaaggattcttccggatgttttaccagataaaatgccattttaaaaagttctaatcgagtttctgtatttatcttttcaagtaaatcctcttccttccactgttcaaaccattttacatctctctcaaagttttcgtttggaagtctttttaaattttctttaaattctttctcataaaagaccattccgtttactgccggcagacgaaaaattatgttcttaaattcctcaatattcattaaaaagccgtgcattgtcacatgtgctcttccatcaaaataatttccattgactttctttccctgcataaccaccatatttttatttccaattggatagattaacaatgctttttctggactgtccacttcaatttcaagacattctttttcaattttttccagatattcgattggaaatccaggactgtagcgtaaaacaccaagtccatttccactttttgtatttctgcctccaataaagtaatacatacctttccctcccgatccctattctaccgttttcctaaacttcttctttaaaatttcctttatactgtcaaaatcaaataatccatctacatctgtttcatctgattcttcgtcttcttcataatctctttttgtctcttttttggtttcttttttagattcttcctttttttctgttgctgttggataaagacctgaatcattcaacaaatacataattggttcttcgataaactgaggattgtactcatacttccattccattccatctgattcactgattcgaaccggttcactgccaatggatgctaataaaccataaaccagtttgtcttctccgatataacggcggattgtattataaaagtccgggcagtcctgactcaaatactccttgattgccatctgcttcttattgaactcttttaagttgaaaccattcttgtgaaccagttttgtatatcttttgccatcccaggaaagtgtcttctgacaaatgcctgccagtttttcattctgttctaaaagcaaatctgctctggtaattgcaacaaaaattttataatcctgacccgtctttttaattttcacttttggaagaagctggtctaaaatttcatggtactttgcaacttcttttccgagcaattcatttgaatcaatcataaaaataatgtaagaagcatttaaaatagaagaattccaatccatgttgatacattcttctccggagatgtcatcgtattttaataaaatattacgttttggagcagaaatcatataataattcgccggataaataccgtttacctttgttccttccggcagtacctgctcataaataaaggctctgcgctcttcatcctgttttctttttagtaaatcgattgccggaaaatcatcatagattgctgtatcggttcccgatgcgatcaaatcaaaatacggcaggtctgtcatctggagacgcaggcaggtttttcctgaggacatacgaccaactgcaacgacctgttgcaccggcacacagcctgcatgaatcggaagaattttatcggtgccggcttttacttttatcggtgcaaatttctgtctgccatcttttaatttcttttttaatgcaattggaaattccgcatctaaatcttcatatactgcttcaattccgttttttccaaccatatctatgcttaaatatttattttcaatcacctggctttcctctaattcccagtcttcggaaagagtttctactccatttcttaattcttcattggtaaacaaaatttcggttttctttaactccacaccatccacttcaaatggaatataatctacctcatcactaatttttaatttttcaaacataaccgttcctcctctttcatgtactctcgaaacctattcttccgtaactaatcgattgatgatctctttcgcaattagtccggcattgacactgcttcccccattaatatgatttaaacataccgtaatcgaatatggtttattttcattcaaaatgcctcctgttacaagtaacgtctgtgtctttccgtctccttcttcaccggtaccggttttaaatgccgtctcaactccatcaactgcaaagtcacgtcctgttccttctctcatgactttcaccatcatgtttttgattctgtctgccacctcttctgtacacatctgtcttgtgactgcctgtgtctttgctttcattggttcttctcgtttgtcattcgagcctaaaataaaatgaggctctgccaggacacctttatttaagattgcatttgtatacatgtttaatccaatcgtggttacggatgcctgtccctgaccgatacatccgtagaccaggtcgtaagcattttcactttcccccataaaggtattatcattaaatttgaatgaaccaaaatgcatcacatcgtcaaatccgaatttttttaagttttttcttaaaatttcttccggaacctgctgcgctaaggcaataaaataaccattacagctctgcgccattgccaactccattgttgtcaatgttccatgtacatttccacctgagcagtgaacagaaaccgtttcttttccctctgcgtctaatgtaaaggtattgttgcctttgcaggtataactgaaatttgcaagttttgcatcgtattctaatgccgatgctgcaattgccagtttcatggtacttgccggatgaaattttcttgaaaatacggtttctgaagaatctcctcccagacataccgcagcctcaacctctccggtttgaaaattactcaccataacagagctgtccatatagccattttcaatcaacagatcttcaataaaattttgtaagtctgcgtcaatcgtaagctttacatttccaccaattcgtctctgatttggatgaaacaaagatttttcatccattcttgaatcggattcacccaaaagttccggtgccatcccaagaatggtcatgcggacatttccggtttccactgcctttatataatctgttcctccaattaaacgctccagagaattactctttttatcactcatccagctaagttttcctggttcactgccaaacatcaatacattatcctttttgtcataaatagtacctggcagatacacttctgaaagactcagtaaagaactgtctaattcctgttctgacattgtcgtttttgcatctgcttccagataacggtttcccaaaacaacagccagaacaagcatcattacaagtgccactttaaacaaacgccatacctgattaatgtaactttgaagtttttctttttttctgaacatttcttttttctcctttttccataaagccaagctccacagctatgtaacttacaaacattgcatttaaacataaccctcttgatgccagaggaaggctcactcctgcactgataaatcctcctgtattagacccaatatgaagcaaaagaatcgtaccggttacaataatgcttcctaacgtccaaaattcttccattgtatctaaagttcggatggttgtcatccatcttacaagcaaaactcctgctgcaatgaccagtattcccattaaaattccgtaatcataaaggattcgtgtcaatgcatgatccgtatcacaagtcgttttaaaaataattgataagtttccaggtcccaatccaaaccagccactacgctgaatatttttcaaaaaataaacaatactttctgtctttccaaccagtgcttcgtcggttactgctttcggtaaatcaagccatacttccagtcgcactctgatatgagaaacaaacctgcaggccaaaaatgctgttccaagacagagcccgatgtaagccatccggatttttaaatccggaatcgaataccagaaaaacgctgttccaagcagagcaattagaattaataaattaaattcgttgcacattgctatgagaggaaagagagctacggtataacctaagaaaccaacatttttggaagaaagactcccaacctttcctccaagatatcctctgctgtgccctttcaaaaaccagcagatagcagtttgataaagcagaacaaccagcggtaaaatcaaaattccaaagaccttaatgtgtgctccgtttatcggattacaaaacagcgcgccgattaatgccaaaggtgcagaaagcatagccagaaagcccagattctttgactgataccagttagtataacaagtaagaacataaaaacctgtaaaaaccaaaatcaaatactttaaatcgtttgcaaaaactctgcagtttgatgcacaataggaaacggctgccccgatattcattaaaaacaacatgatgtaaattccctgtcgtttctttcgattcttttcccatataatactgattacgagttctactgctaacagtattgtaactacccatacataagccaggctctcatctaatgatttcttattgctgaatacagtccagaaaagcaatgaaaaagaactgataaaataaactaatttttcaagcattaatcttcctcccttctgaaatcgattttaattccatccataaaaagtgttgtatttcgtgtgatatgtttctgtatggaagcattctcttttaaaacagtcccctccatttcgacttccccctttaaaacagtcaataaaattttgttttttgattctatattcaaataaagttttactttactcttacatccgtaaattctgatatcgttaaaccaccctgttccaagtcgataaataccaggctgaagtgaaagttcagataccatatctttattttttaaaaagcgtttcattcttccgattcgcttaattctcagactccatattcctggaactttataaactgttttctgcattgtcgcactttcataacaaatgaaaatcaaaaaacagatgaccgttatcatttctaatgtgatgtttgtgattctcacttcgtttgcctccttccttttataaaaatctcgcttgcaagattctctgcctgcggcgggtcgcttttgcgacagctttcctcaccgcccggtacaatcctcgcaaagcgtttttaaattcataggatgaagttccctatgaatttaaaaagagcatttctgtataatttaactatacaaaaatgctcttgaatttcgtttctaattttatttttttattgctttttattctttccagaagcaatcataaaagatttttacttctcccttccagttttccgacatgtttctctcttcattgatatgataatgtcctgcgtaccaggcttttatggaagaaccaaatcgttcaaggatttcatccattttttcttctgtccgtgatgtctgttttcgttctgtaaatacttttgcacaacttttcggaagcacatgagaaagtacaattaagtttaataagtctaaatctttttgattcttctcttctaacctgacaataattttctgccattctatctttgaaagttcttcatccggccaccagccttcgttatttaacattctcgaaaaataatccgaggaatatccaccaccgagtaccagatactgactgccttcgattttaaataattctccatcttttaaaaaaatcagattaggatattcagattccacatagacttgtccaccccatcgcatctgcttttcataagaataaatgttttccggtctgcactcatgatttcctcgaatcaataaaatattacattctttttgattcttttgccaaaattcatccactgctttttgaagctcttgcttcttttttctgtccccttctcctaaatcatagttgattcctgcatctccatgcacaaacagataacagttttcttttccttgatttttttgaataaattcaatgatacgactcatgttcccgtgtaaatctccggtatgtactctcatcttcaaatgcctccttctattctctatatatcaaattttataaagaaggttctgaattttgagttaattctcacattttacctgattcaacaatcgttcatcaatttctattgttttattctttaatttttcttttaatgcatctaaaatcacttgcggatgcgcgcctttttgctgtaatgtttttaagatttccaaatcttttcttacttcatctgcagtccggtattcttcttttccattttttttcatcatttcaagcagcttttcagccacgctttcactgcatccggttcgttcctgaatcttttctatgttaacacttccatctcctttataaacctctccatatagaagccggaacataacctgaatacagctgtaaaggtctgtagctggcgtaattgcttttactgcttcaagaagcaatccggcacgtcttgctgttcgctcttctatatatctcgcttttgcaacactaagctgaaaaattttcggagctcgatatccctcactgctgcatccaattccttcgttaaatacaatcttatctgccatctccttcttttcctgccggctcatggtctttaaatcatatccatattcgtcataagaaaatacactcccgaaatcaagcaggcaaaatgattttgccacgccctctccacgaatccagatattctgccctttaatatccccgtgacagtatttatctcccaaaagctgttctacaatcactaaaagccgttcgattgattcaatcgcttcttcgatgctaagccgtcctttttctctgacataagcttctaatgtctgcccttctgaagtatccagaatcatataactgctgtccccgtaatgcgttaaaaattccgtatgaaatgcataaggactgttattttttccatcaaaatacatctcatttgccaaacgaatttctcgtctgacattttgttcctgacgtttcttttcttcttcacgatcctctgagcgaatgcaaatcggctctcctgctttttcccgataataacgtttcacaggtgactgactttcatctggaaaatattcttttatgatacacatctgtttttctccattgaaatgccggattcctttataagcaatcgctgtgcctcccctgcccactacctgaatcaagtctactttcaacactccgcttttttcatccgccagtgtaattttttgtttttcatcaatcagactctgtctctccattcttttactcccattttttattcctattttttcctcttacttagcatttagcaaataaaatatcatgaaaaactgcatagccctcttccagacagctatcttcaaaatcccatgaagccattcttaaccgattaactctttcttttaaagaacacatttcttccatactttcaaagacttctataaaatattcatcaaacggtgtgtccaaaagttccgttccaaatctgcaattaaataataaattttcatttatgtatggaagctgaatatttgctactccaagcgctttaattccaagtactacaagcagtaaaaattctcttgaaacctctctttctccagtcagaatttccttaaaaatcacttccattctacggagttcataaggtttttcttctgcatccattccatgtctgaccgctcttgcttcaaatggtgcaaatgcctctcctttttccaaatcttccttaatttcatcttcttctaagccatctattacataatcattaaataccaaacctccgtcaaacaactcattgaatacgtgaatgactttcgtataatttaatctccggctcatcagatattctttccatttttctgatgaaacctctttatactcgtcaatgtattctgctattttcgataacggacgccccatttcattcgtttttccaagcccaatatccgtcaaccagcactctttgagttccttctttaactgctctttcatcgaagcatccgtctgccaaatttgaatatctctacaaaatttttcaatctgccctattacaacaagggataataaacggtataaataccactgtctccgttttccggtatcacatacatgcaaaatcacttcctgattaaacacttcttccagcttcgtttttccaagtctggtcggatccgcaataattccattcatattttctgtaatgatatccagcgaattttttgtttccattccggtttcatccagtccagctttgattctctcacaaacttctttgaaattttttgttgtcagattatccatttcaaaattcaatgcatacgctgtttctttccgttccttccaatctttcgataagcctgcccaaatatcaaatccctgatgtgtttttaagacataatacaaaattagttctgtcatatcacttttattatccatacgcattaacgcatacttgcaccccgctgattcacagatatcttcataaagttccagataggattcttctttatcaatatttagctcattttcaatcacaacaaacatcagagtcatacactctaactcggagagctttctctcttctacttgctctcccgattcttctgcttttaaatcctttataaactgtgtaataaatttctgacgcaattttttatgtccatttaaatattcaaattccaattctccaatctgctttatcatttcttttgacgtttttactgtctctttggcttcccatttttctattgaatacggataatctgttatttcagcaacgcacttcaacacttctctatacatctttatcttctcctgtcttttttattctaaaaccttctctcagaaaattgtttataaatactcctctatcttagttcgatattctttcactaattcttgcagttctgtccacgcttctaattcctctaattttttctgcaaatctttcaaaacaccaacattcattcttctgtttgacacagctaattcaactacacgctcgatctgtactggcagttcttctaagatttgtttttccagattttcttctttcttttcttttaacagacaaagttcacagccaattgcccgcactaaaaataacgcatccggctgtgtcttttttactgcttcccgataagtttcatatcctttttcatattgtttcatgcaaaaataatcactcataatcgtccggtaactgtccatcactctgtcaggaagagaaatcttacgaaactccaacgcttttttatgccattttaaagcttcttcatactcttttctctgataataatagcttcccatattcgaaataatttttccgtaagtcaacttatattcttcctgctttttttgatattgcggcacattttccagttcttttattgcggcttctaatagcggatacgcatccctcttcttctctttattacaacaataatataaaaaattataacaagtcccttgttctaatggcgttaactttattttttgcatttcctctactgcaatccagccaatttccacacacttctgattctcacttaagtcttcatgaagtcctgcaagctcataataaaattcaaaggcttctttttttacttcgtcctcttctgctaaaaagcaatacaattctgctccaagctctccataaatgaattccgcaaaatcaaggtgacggcatcttctgctaaattgggctgctttatcaaacttaggataatattttaaattttttattaccaaatctataacttcttttctattctttgtctccagaaatgcacacaaagccagatattctctaattgtttcatgcgaaaattcaagctgctcatctacgattcccagctttggaaggatttgataaatcaatgccttcgtcatattctgcggaattattgtctcactcaaaacttgttccaataagctttgatattccaaagttctgagcttgttttcttccgaatccacatttatccaaagcaacgctttctctacttccaatgctatcttcggtaaaatctcatgaattaaaaagcgtcggatctcacgaatattatcacgatgcgcttccattgaatctgctaaaacatctagctcaaaatatttttgaagcaactcatttctactttttaaccgcatcgcttcttccggtgcacgctcataaatctctcgaaaaagttttaaaaacattgggttttctaactcttcttttaaatggatttccggtgccacccattgtgtaggactcagctttaaatacgcatcaatttgtgttttctccagcttttcaaattcaatctttttaaatttttcttgaatcgaagggtcataaaacgaaaattctcttctgcttgtcataatgatatttacatttgaaaaagaactaagctcccgaatttcattttccaggcactcgtataccatcattccattttccagacaataatctactaattcattcactccatctaataaaaacaagaacaaatactcagatgattctcttaacatcttgcataccacatctgtccgtaccgcctccttaaaaaacgcacataattcatccagcaaaaagtttcctcgaatccgttttcgattccagacattcatcttgaaatacaacggaattactgttttattgttgagcattgcccctgtcagttctcgctctaataataaaagcgatgttgtttttccggttcctccagatccacataaaatataattttcaggataagtttgataaaattccaataaattcaaatggttcaccagctttcgtaaataagtatatctagacttattatagcaaaaaaagccagcactcaaaagcaactctgggattaattctggaaagaaccttttcctgccttgaaattttattcttgctggcattaattacgataaagaaacaaaacatcacagttgttccattaaaaaaattgatcattctaatttttagcatattaaaagagatggtttttcaaccatctctttttcctctgaactcacttttctcgttttaatttttttctcataactccgccaactaatacacctgctcctgaagttttttcgtggttggttttttcgtcaacaaccgagaattcccgccctaattcttaaaccttcttcatgcaaaaaaactccccgccatctggcgaggagttttccacatcttattttacattctattcaattacaattacagtttcagattaactccgatttcattcatatttttcagaattgcatctaccgcagcctgcacttcttcgcttgtcagtgttcttgtatcaagaccaaaggacaaacgaatggttacactcttcactcctgctgcatcatagatatcaataaccgaaacttctcttaagatttcaagttctaatttcttccagcactcagaaatcgtatcaaagcgtaccccttctggaatcagtaaggataaatcatattcaatcgtcggatatttggatggttcattgaactctaagtccatagccggaattgcaagtaatacatccatatcaatttcaatgcataccactgccgcatttttcgcaatatgagccaaagtctttggatgcagtgtattcaaaataccgatttcttttccgtctaccaaaatctttgttgtattcttcggatgctgccattcatgtcttacttctgttttttcataagccacttttttatgtttcagctgacttacaatggtatttaaaagctgcactgctttaatatataatttcttttcgctttcttctttactgtacatcgcgattccgagcatgcgatgttcatcggcagtctcatcttctcttactcctaatacggtacgcgcaatttcaaacattccaaagcttggtttgtaattacggttattgtataccaatggcaggaagctctgcatcatgctggttcttaagattccattgtcgtctgcatgacctaaaagacgtacattttcttccggagcaagtccaagatttctaagagcatccggatcacaccataatctggtattgacttcattcattgcataagcttttaccagtaagtctttaatcagattttcttcttttctgcgttctgttgtctttgcaggaagcagcggagataaggttgtcttgatttcaaagttatcatatccatagatacgtgtaatttcttcaataatgtcggctctcatgctgacatcttttgttcctctccagcttggcacttctgatacgaagttttcgccgtcctgtgtggtcttaaatccaagctgttccagtgttaatttaattctttcacatggaatatcaattccggtataacgatctacgaattttttgtcaaactctacttttaattccggatattttttcacatacacatctgtaatcttacttgcacattcacattccgggtctacgtcttttaaaagcttgatgaaacgttttacggcaagcattgtcatttccggatcaagtgtcttttcataacgtgcagatgcatcggtacgaagtgctaatctggaagccgatttacgaacacttaccccgtcaaagtttgcggattccaatacaacagaggttgttccgtctacgatttcactgtctaaaccacccatgattccggcaactgcaaccggtgtttcattatcataaatcatcaaggtatccggtgtaatttcacgttctacatcatccaatgttttgaactggaaggattcttttggcgtgtcaactacaatcttttcgattttatttccgtcaaatgcatgcattggctgaccaagttctaacataatgtagttagttaagtctgcaagcagattgattgctcttgtaccacagtagaacagacgaatctgcatttccattgaactgacttttttggttacattttcaatgcgcatgcttgtgtaacggaataccaggtctttgtttgctacttctactgcaacagttgcatcacctgtgtatggattttccattacatcaagtggttttacatgctggttggtcagtgctgcaaactcacgagccattccataatgtccccataagtccggtctgtttgttaaagatttattatcgacttcaaataccacgtcgtcgattgggaaaatttcttttaaatctgtaccgttctttaagtctgcatctaattccatgattccgtcatgtgtctcagaaattcccagttcttttgcagaacaacacataccgaaagatttatatccacgaattttggaagctttgattttgattccgcaaacttctccgcctactttacaaaatgcggtttttaaacctgctcttgcattcggggctccacatactacatcgtaaacttcatctccggcatccacttttaataaatgcagatgatcggaatccggatggtcttcgcaggaaagaatttcaccaacaacaacatcttttacatcttttcctttatattcaattccttctacttctgctgtagaaagtgtaaatctgtgaatcagctggtctaaatcccatccgtccaaatttacaaagtctttaatccaattcattgatacgaacatgtttcttcacctcctatttacttacgaactgtgacaatgcatttaagtcaccttcgttaaatacacgaatatcttttacgccatatttcatcattgccagacgggtcagacccagaccaaacgcaaatccggtatatttatctggttcttcttcggtgttaattcctgcgtattttaatacgtttggatgaatcataccacatggacacagttccagccatccggagtttttacaggatgggcatccgtcaccgccacagattaagcactggatatctaattcaaatccaggttccacaaatgggaaaaatccaggacgcagacgtacttttacatctctttcaaagatttcagaaagcatggttttcataaaataaatcaggtttgaaatagagatgtctttatcaatcataattccttccatctggaagaaagtgttttcatggcaggcatcgattgcttcatttctgaaacatcttcctgggaatacggcacgaatcggacgtccttcttcttttaatgcttttgcatacttcttcataattgcattctgtgcagcggaagtatggctctttaataactggtttggtgtagacagataataggtatcctgcatatcacgtgccggatgatatttcggaatattcagtgcttcaaagcaatgataatcatctacgatttcactataatcttctacattaaatcccatagattcaaagatatcctctaattctctctgaatcagagtaattggatgataagaaccacacggattttctgtcggaagagattcatcgtaggactctgcctgattgatggctctttcttcttccagacgaatcagttctttttctttttcttcaaattttgcaattacttcctgtttaaatgtattgattaactgtcctgttgtctttttctgttccggcggaacttttccaagctctttcattaagcctgaaacatacccttttttacttaaaaaatttcggcgaagttcttctaaagaagaagatgcatttacggttccaagttcatcttgaaactgttctctcagtttttgaatcttgtctttcataatttcctccataaattaaaaattcaagcacgcttctcatttattgaaataaaaaaacctcgccccacaaaaagggacgaggtatctcgcgttaccaccctaattcaaaaccgctgtttttttattatttctattctttctcttatacggttttgctctcatctggctttaatgcagccttacatctgacttaacgctgaacttttacagcttttcgccagaagctcccgtgctgaaattcgatttctgatgtttttgcttctgcttacagccggtgacaaaagctctctggaaaaacaagttcaaaaatctacttacacacattcttcgctttaaaaattctaacatacttttttttaaaaatcaataagaaacagccgaattattttttaataagccagctgtttctcttatctttttattcttttactccacctaaagttaatccggttacaaaatatttctgtaagaatggataaatacaaataattggaagcattgtgataatcgtagccgctgcacgaaccgaagtaggtgtaaccgctccaattgcatttttcatcgcttctgccgaaccaccctgatttgttacagacgacaacagtttcatcaattcgtattgaagtgttgtcagactactattcatacggttatacagcattgcatcaaaccaggaattccactgtccaactgctacaaacagtgcaacggttgcatacactggtttgcataacggagaatagatttttaagaaaatcgtggtatatcctgcaccgtctaactgcgcagattcttccagactattcgggattccgttcatatatgtacgaattaccaacatattaaatgcacttaccattccaggaattacatataccgcaaaactattggtaagtccaagtcctttatataacaggaaagtcggaatcattccaccatttacatacattgtaatgacccagaataaagaaagtcctcttttaaacaaaaaacgttttctactaataataaatgcaagaattgcattcgataccaaagccagtactgttccaataatcgttcttgatacggtaatataagcacctgtaagcagattatctttttgtaatacggtaatatagtttttccatgtaaattttcttggccaaaggtaaattcctccacgaagtgcatctgtaccatcatttaatgaaattgccaatgtatttaataccggatataatgtaataattacaagcaaaatcataatgattgcatttacaattggaaacacttgtattttcttttttgctttttttgtctcttccattgtcaaattcctcctgattagaataactgttcctcaccattatgttttgcaatctggtttgcaattacaatcaaaatgatactaacagcacttttaaagatacctgccgctgtaccaattgcataatcaccctgactgataccccattttaacacgtaaatatcgattgtctgagatacactctgtaccaggccatttcctaaaagatactgaatttcaaaacctgcatttaatacattacctacattcataagaagcagaataataattgtaggtttaattcccggcaatgtgacgtatttaattttttcccatcttcctgcaccatcaatggaagcggcttcatataaagacgggtcaatagatgtaatagccgccagataaataattgcattccatccagtttctttccatacatttgcaaacgctacaatcggccagaaatattttgtatgtgcgaaaaagttaatcggcttactaatcagatgaagatttacaagtaactcatttataattccggttcccgaaagcatatcatgtaaaatacctgttacaataatccaggaaaggaaatgtggaaggtaagaaattgtctgtacgactttctttccaccttttgatttgatttcgtttagtaaaacagcaaatgcaattgctgtaaaaaatgtaaccacaagattaattacacccatggccagcgtatttcgaattacgcgaataaatgtcatatctgaaaacagcatccggaatttttctaatcctacaaattcagaatgaagaattcctgttcttggcttataattctggaatgccattgcccatcctccaagtggaagatagtaaaagataattccatagattaccattactgctgcccaaaacaatagtactttctgacgttttatttctttccatgtgattttatttttattttcttttctcgattttgtttttaccattgccataacatcactccttaaaaaacaggcagatgaaattttatgctacatctgcctgcctttaaatttcattatttaaattgtgctgcctgttccattcttctgtctaattctgtttgtaattcactaataaaatcttccggtttacaatcgctatatgctttcatatattcgctccatgcaccgtcaaaatcttttgccattacaacctgtggcagtttttcatgtttcaattctccaatttttgtccatgctacaccaccgtcggtatctgttgtaaagttattggaataactccacattggataccagtctccaggtgcatcatttgtaccaagcatctctacataagtttctgctccatacgcctcaaatgcttctttgatatcatcatttaagcctgagaaaaattcacttgcctgtccatctggtttatttgcatttattccatcttcacttgttcctgtatactgtggtaagtaagaataactgcacatatgtgatgctttatacgcagtatcggatacctgcattctttcttccggagttctgtaaaattctccgttctcatctacttcatagtctttaccctctacgccccagaaacgtaagttatgtacttcttgtgaaagtaaatcattcacaaactgtaatgcaccttctacatcctcacagcttgttgtaatcgcaagtccacttgatgcattaaatgctccaccggcattatgccactggttatcacgcccatcaattgtaacaggaaccggaatataatcacagccctgcttatccagtccggcttgtttaattgcatcatttgcatttaaaaaatcccaccactggtcaatcattccaagtacacgtcctgaagaaagttttgagatatattcgtcatagctctgagtaaatgattccgggtctacaattccttttttatactcctcatttaactttccaaaatatgcttttgcagtatctgttgtattgtaatccataactttctgagtttcagggtctaccatacaagaaccatcatttggatatccatccaagaacattggagcattttccagacagaaatatctccagtcatcgcataaaatagtatacggaatattttctgttccatcttccattgtaggatttgcttcattataagactctatcagattaaaatagtcatccattgttttaatttctggatagttagcccattttaatactcttgcctgaatccaaaatgcttcatcattatgagtacagactttttcttcacctttgatgcagctaaactgtggtatccagtaaatatgaccatcttcctgtcttaatttttcccattcaaggtctgtaaataaatttttaatattcggatagtcatccagataatcatctaatggaacaagcgcttctgcatcatataactgttgtgttccatttcctccctcaataaaatccggatactctcctcctgcaatcattgttccaattgcttctacatccgtctgtcctgtcagccaagtttcttttacttttgctccagtcttttctgcaatcagttcctgaatctcattatcatcattaatttccgaacccggaactgcaaaaaaggcagtaaactcttttactcctccttcatctgaacttgatttactttttccactgccgccgcatccagtaaataatgtggcagccaataccgtgcctatcagtacacttgcaactacttttcttctcatactgtaagtacctcctttttgatatatttattatacttgtttcactttttacaaaccagctgagaaattatagtcaaaaacaggataaattatagtttttctttatttgttctataatttatcctgctttttattattcttcaaacatttgttttctaaatcttgccggagtgcagcctttcacctgaataaatcgattcacaaaataatccaggtcatgatatcctacttcctccgcaatttgtataattttcttatctgtatggatgagctgattcgatgcttgctcaatccgataattatttaaataatctttaaaagactgtccatatttctttctaaataactgccccagatatgcactatttacataatatttttcacttagcccttttaaagtaagattagaagcaaaactctcacgaatttctttttctaccataccaagaactcctcttgaaacattctttctaagttgaaaaaggtactctgcatattcacatgcaaaacttgcaagatgcgctttacttcctcgcataattccactttcaaaactgctctcactgattaatcttaaaatttcctgttgattcacatcatcatcctgctcgcttgcaagatgaatcaagcgaaataaaagataattgatgttaagcgtcatggtctcactgttcattcccatatttcccatttcctggtaaaataactcaattgccttttttatttctatataattattttgctcgattgtcccaatcaaccggtccagactttctttacacaatacaatcttattacaggatacctgcacctcatcttcgtaaaagtaaatggatttttgcgcccgaaatccctgaaaggaccgaagcatacaggtatttccataagactttgaaatactgttgatatctgaaaccttctttccaaccaacattatcagtggctgtttcatattatttaccagatattgataaaacttttccagataagctctttcatctaatcctaatttttgcgccatcccatctgcaaaaatcagaccaatatcatatattttttcattcgcagatacatcaaacacacaatggtttgcatcttcttttaaaaattcaatgcagcactgatataattctctttgaaaatttctcatatctttttctatactttcatccatttcctcggattgtgctttttgaatttcaacataacgaactccctctatattcttcatatgttgttttacatattccaaattgaaatcatcatattttccatgaatcagtgcaattacatttctggaaaagtaagctttttcctgctcttttcgctttttatccaattctctatcctgacttcgcattgtataaactttttccagtaacttaagtaacatttcacggtcgataggctttaaaagatattccgtacactcattttgcattgccctcctcgcatactcaaaatcggcatagccgcttaaaatcacaaaataagcattggataatttttctctttttatggtttctaaaagttcaagtcctgtcatctctggcattcgaatatctgcaataattaaatctacttcttcttgttctaaaaatgcaattgcctctttcccatttgcagccatccctgcaatttcaaatccctcctgttcccagtcaatgagcatttttattccttgcagaataaatggttcatcatccactaatagtactcttaacacttaattttcctcctcatacatattcagcaggtatctgaatcataaccatggttcctaccccttcttctccttcaatcgtaaatttcactttatcatctgaaactattttcagtcttaaacaagcattaatcacccctactcttccttttactttcagcatttcaatacttgcattttgcattttattttgtaaatcctgatactcattttcgctcattccattccctgtatcttctatttcaatatataaattttcgtttttttcatagattcttacaaaaatccatcccggagaggatttactttcaattccatgtacacatgcattttctacaaatgtgaccagagtaagttttggtataattttcttctcacattttggacttatatttatatcataatttaatcgctctccaaatctatatttttgaagtgccaaatatgcttttacaaattcaatttcctgttctatttccacacagtctgctccccactctacatactgtctttgcattaatgcaagtttttctaccatatctgccgtttcattttcttgttttaaaatactatgcatccggatgctttcaagcgcattaaataaaaaatgaggatttatctgactgtgcaatgcaagtaactctgcattttttcttcctactataatctcttgttctctgattttacttttatacaccgtttcaattaaatgattcgttctctctaccatacgattatagttgcgaatcatacttccaatttcatcttttccccgttcatctgacatataaatcagttgttcattatttacggactgaaatactttacttaattttgtaatccttttggtaaaagaacgattgattaaataaacaaataaaaccggaagtattacatttacaaaaataagtaataatataatctggaatttattcataagactatcccacccggttttctcactttcatctatacggatttcaagttctgtcccgtaaagatttacctcctgacaataagtgtatttactccttttctttactttttcataattttcactttccgttccatgctttttattggaaagcacaattcttccctcatttaaaatttcaacttcattatcataattcattttctttagttcatcgcttacttttccataatccaactctacttttaatattttttctttattcggtgaatagaaatctaatttctgcaagaaaacaatctgccttttttttgatattttgtttctgctctcatcatatacgaaaaaaatccctttgctttttttctgttcgactaagctttgatacgcttttgtttctctgatattttcaatcttatttacctttcctccatttactatcgtttcattatctatgtaaaaagtaaatactaaattattcattcctaatatattttcaagtaaatggtccttgaaaaactcctgataagtcaacacatattccggagcactttcatattcttgcatcaaaaacgaattgatatatttactggtataaatactttttgctgtttcccctatgctgcttatcgtattactgatattatagcttactgcatttgcaatatttgccatctcatgttgttgtttttcctgttctgaacttctaacaatgaaaaagataacactatccgtgataataatggggattaaaacgcatatgagataaagcatgtataatttttttttaatttttaagttatccatcccttcttctatccgatgcaataattttctcattttcttctttctcctgcttttttctaaaaccacttcagggagcagaaaaattctgctccctagtcaaaaatcctatatctaatcaatccatatttttcaaataaaaccaaccaaaatccgcataattctcactttgttttccatttgaagacgcatacattcctaccgtacaccctacaaatcctcctgcctcttctgttgtatacgcagtaagaggaatcttttctgcaaccggtttaaggtttttctcttttccaatccatactctggcttcctggtcatgacattgaatcataatttttaaaattccctgccacttactaatatcaactattgaaagttttgtctcttccccatgaatataagagtttacttcaaatacttttttcccttctacctgttttatttcaaactttaaatgattttcatggttctgatacaaaatcactcctgctgtttcattttctgccttcggttcaaattcaatccctgtttccacctcaaaacgataacttttttgtcttaatcccaaataggaactgtagtctttttctgaaattttctcttttctacagtataatcgtaacattccttttctctctgaaagagaataaatttcttcatctcgtttttcgattcctactagtctttcatctaactcattttcccaaaactgaatacaatctgaagaagtcacttcatttgcaaaacgatgttcttcaagcggaatctcaacaaaatcttcaagccgtccaacttgtggggcgataaccggccatccgttttcccagataactttcgccaaaaaagtctctcttcccatgctgctatgttttttacacggtcttgatgcaagcattactacataccagtttccatatccatcatccacaaggtctccatgtcccgcatagacaaccgggtaatccattcccagatttctgtgtgtaaaaatcgggtttctaggacagccttcaaaccactgaaatagttttttacttcttgctacactaatgctatgttctggtcctgttccaccttctgcatgcattagataataatactctccaatcttataaatatgaggtccttccggccagatgactccctttacagcccctttccagattgccatactctcgccgaccagtttcatactctttaaatcaagttcctgaacccagatttcccagtctccgttgtagcgtaccccttccggattcggccttgtgccacaatagtaacacctaccatcatcgtcaaaaaacagacttgggtcaattcctattgcttcttctcctaaataatatggttctgaccatggtccttccggattctttgcagtaacaataaagttccctccatagcttacgtttgttgtaatcatgtagaaaagcccttcatgatagcgaatcgtcggagcaaaaatccctctcgaaatttcgcttttttcaacttgaagctgctctttgctttctaaaatatttccaatctgctcccagtgtgctaaatctctactatgaaaaatcggaactccaggtgcatatacaaaactagagtttacgatataaaaatcattccccactctacaaatagatgggtctggataaaatccacttaaaattggattctttgcaattaccatacttcttctcctcctatttcacatatccgaatccaagaattgtaaaacatttctctctttcttcctttggaatctctattcggacaatatgttctttcgtttctttttcattgaataaaatgaccgcattacaatgaagccagttattgatatgtgggtctgcacacaggcaatattctgtgtctacccaaacatctgcttttcccacatttgtttctcctgaatctttaaatatcaataataacgccttacagcttattttcatctcaaagtatgcattttccggcgaatctccattatacatccaattatgcggaaactctggcactgtcattaaagaatcatcgatttctacacattgcaattctttatcacaatgtacaaatcctccctcatcaatcttcgcacctacataactatcttttttatctatcaggtggactgactcgaaactatttccaatgacaggtgtttccagaagccttctctctaatgtttcctcatcaaagattcctgttacaaatttattttttcttaatccctttgtttcttcacatcgttcaaaaaaatagctaagacaatctgccataatggtatgtcccaaattgctcggatgaaacatatcatagaaaaactgattcttcgttatactttgtttttctttgtttttaaactgaggcactactgcatcttttatgctgaccattggcaaatcatatcttaatccaacaggcatcaaacgttcttgaagattccagtcatttgcaaacactgaaaacagcaaaataactgccggtttccatggaagcttcaaagctttacgtacaaggctttcataacagtctccctttgtttcatctccttcatcattcactgcaaattcaatgacaatgatatccggctgttcattttctcttaatacatctctttcaaaccgtaacattccaagctccgatggagttcctcctacacctgcttttatgaattttacattttcttttattgcaaattttttctgaaacatcttccacgatttatacgcataacactccgtatggatcggcgttgctcctgctccctgggtaatagaacctccaatgtatgctaaagtaacaggcttgcctgattttgctttttggattgctttttgtatccggaaagtattccccatacttaacaatgagctgcgaaccatttgactgtactgctctgaattaatatttacggtttcatcttctatttgttctggggcatcatatccatcgtttaaataaagttttacacttgcttttcccattatttccggagtttgaaatataaattttatctgtcccggaatattatcgtcttctgtccattgatattctgacaacaaaatcttatattccattccatcgccttttaatttcgtttttaggtttgttcctcctccatagaggtcattctttccatatatctgaaatataaattctatttcttcttccggattctctgtttctacaaaaattccgatactatggaccagttttccaaacccttctactgtctctaaaagctttaactcctctttatctgtaacattacctgctatctgtgcgctatttattaatcgtccatcactctcataaatatattgaattcctgttccatcctcctgtctggaactaaaaatttctttttctctcataatataaaaatacggtctttttttctctggatttttcggtgcttttggaccttgcatctttctttctccccagtctcattcttaatttcatttattataacagactacactctttagaacaccgggagaaattatagaaaaaactccgacaaaatattacgttttattcgaatcctaattattaataaattcgatagtttccagacaaagcaagcattgaaaacatataaaggaaattatcataatatcttctgtctcctgtgcgaagcggtgtattccagaatttctctacacattcttttgcatacggaccatttgctgccaaagatgcctgagcattcgttgcaataattgccaccggatgcaatgctttctcttctagtcttgttccatctgttaaaaatactccatcccaatgtagcttctggtcctcacagtaaaatttctgaagatgattcgcattttctacctgccaggaatctactccaaaccactcataatccagtccgatatttgcaatcgttcgataagcatcactataataccaatcatgacgtccaaaaatctcctgatgccctttatgaggagttccatcataatccgcatattccgccgataaacctgtttttgggtgacatgctttatgaagatagtcgcgacttgcctttgctgcctctttccaaaattctctatcctcgggatttgcccattttgcaaataattcataaaaatgagggagatgataagatgggtcactaaaatcacagtttggaataaatttaatcaaatggtttttcgcatcccacatagaatcacccggttgccccggttcgcctttatgtacacattcttttaagattgcccttgcctctttactatactcaaaaattccttctccgtcaccccatcttctccacgcaaagaataaagacatcgcaaaaaattcttctccatccggagccggtccatctgaattccaagttccatcagtgccacacgaccatgcaaaataattttttccaggtcctttcggaatatacatataagtacgaacccatttccaaagacggtcaaattcttcttttctattcatctgtacacacaccatcattgcataagacattccttctgttcggacatcgtgatttcctgtgtcttccacatacgccatgtcttctccgacttcatggtaaaagcgttcttcttctgttccataaaaaatagtctcaaaggtcttctctactctctcttgaatttcctctttagaatatccgcactccaaaaatacatttcgatattttcctgtctgataagctgctgtcattttttatctcctcatactatattattttctctgaattttttcaattataacaaattccatctcatctaataccgggaataattatagaaaaacctccgacaaaatattaagattctttcattgataggtccctttagtttaaaaaactctccactttttttccatctctttcttgcgaatagatatgcaaaaattgcggagtttcttttttcttttaataaaaataaccaatagacatgaaaaaatcgagatatccacaatctttcttcatgcctattggtctactattctaattcacatcttctctttataatatttttctttcaagcaaatatttttttatttcttttgtgaattcatatattatatcttgcactccaagtggcataaaatcatctcctttccgtatcagaaaccgtacgttttttatatttttattatatagtgtttgtatttccagatcaatgtccttaatccctgatacaaaaagcacaaaaaatcccccagagttactgcccaagcagtttctccagggaattttagctatccaatcaaaaatggtatcacatacgccacaagtacgattactaccgcacatgcaaccacaatgctccatattttaaattctttatccatttttttcttttcttccggacttggtatttcttcttcaatgactcctgacaaatcttcctgtacttcatttttatatttacttctgcagactgcataaattacaagtccaagtgcgcaccagataattcctgttatcattgcttctttatctaattgagtcatcataatcaaataaataataatactgattggcgctcctatcataattccaggtgctttaaacggacgtttgagttccggatgtctttttcttaaacataatgatgcagtaattccgatgacgtagtaaaacaaatctgcaaacaaactcaaagaagcaatgtaaatcatagaatttgatgcaatcaaaaatgccgaaagcagtccaagcacgataatggatacataaggagtctgatattttgggtgtacttttgcaaagatttttggcattgcgccatctcgtgacattgtaaataaatatctcggcggaactgcaatacttgcatttaaagtagaaaaatctccaccaaaggcaattccggctgccaagagtaccagcggaaatccaagaattccggccgttttcattgcttctgcaaacggtgcagacgcagttgccaatgaagaaatctctgaaatcggtacgattccgactaagaaccactgaaatgcagagtttactgcaaatacaataaatggtgccagaatcagagcgcgtggaatattaatctgcggatatttgatttcttctcccattgcacagcaggtttcaaatcctgcaaaacaccaccaaatcatactgaccgaagcaataaagctaagtggtgttgattttgcaatgaaatccggcatctgtacaaagttcggcatatttacatttggaagcatcattaagaaccagataattgccacaccccagaagaagaacataaatccattctgaagttttccggtcatttcaattcctcgcacatttgttacaataaataccagaacaatcagtgtcgctacaacggtatcactgactggaagttcaattccaagtgcagagaaaaacgttttaaaataaaaactaaatgccagtgcttctccacttgttaccgataccagtgaaataataaagttccaaccagccagcattccaaacggttttccaattccgagggaagcatattggtaggttcctccggcatacggaagtgcggctcccatctctgcatataataaagatggataaatgctgattaacattgcaactaaggttgccagtataaccgccggtcctaaatcaccaactacattggctcccgtcgtaaacagtccaactccgacaacggttccaactgtaatggtcacggcttctctcatcccaaatgttcgctttagcgtttttttcttttcctcactcatatctcaagcccctcttacttttatttttgtaaagcggacattcgcaatccgcttcgctacttgctcatgaacgcagtcgcttcgcaatctgccagtgtgagctttcaactcccactggcataagcatcccttctctcctgcctcttagtgctctgcgcacttgaagcgggggaatgcttatctgcgttcaaatagtataagttatttccgaatatctgctgccgctttgtgtcccattaacccttctccatcagccagtcttgataccagcggagccaattttttcgatgcttctgctgtcatactctgctgagtacaggtctttaagaaggttccaacccacacaccaccggtatagcgtgcggcttttaaagtcggaagggtgtgattggtaccggatgcatagtccccaaagacttctgcggtattttctccgataaacatcgaaccatagttgacaaatccttcaataacttcttctggatttttcaagtttaactctaagtgttccggtgcataatcattgactaaatccactgcctcttggatatcatccacgactacgacttctccgtaagttttccaggattttcttgcaatctctgcggtttcaagtacctgaagttctgcttctacagcttcaatgactgcttttccaaatgtttcatcggttgtaactaacattccttttgcattgacatcgtgttcggactgtgcaaggaggtcggctgctacaactgccggtgttccgctgccatctgcaatcacaagcacttcacttggtcctgcgacaaaatcaattccaacttgtccatagcactgcctttttgcttctgtcacaaaacggttacctggacctacaatcatatcaactggtgcaatctcttctgttccataagaaaatgctgcgattgcctgagcaccgccgactgcataaatttcatctacccctgcaatatccattgcaacaagtgtcttcggattgatttttcctttacctttcataactggcgaacaggctgccacacgtttgactcccgctacctttgccggaataatcaacatcaatgcggtagaatacagtggataatttccacctggtacataacaacagcaggaattaaccggaataattctgtgtccgagaaagattcccggcatcggactgaagttttccagtggttttacggtctctctctgcgctttcgcaaaggcacggatattagaagcggctgcttttaaatctgcgatttcttcttctgataactgtgcatacgcttcttcaatttcgtctttcgaaacacggatttgttctctctcgcacgcatcaaattttcttccatattcctttaatgcctcatccttgtttgctcttacattatcaatgatatcctgtaccagacgggataattctcttctgtcttcttctgttctttcctgtgatttctttaaaactctcataactaaaaacctctctatcttttatgataaattacttttcttattctctatgctactatattaaagcgtctagtttactttaggtcaatatagaattttctcattttttcttcaaaacatggagtatactccatattttcattgatttttttactccaaactactacactacaaatacaaataatttttatgtgaggaatttttatgcgaattggaaaagtttcaaaagaatatcatatctccatcgataatctgcattactatattaagtatggacttcttgttcccccaaagccaaagggacagtatttctttgatgagaccacgttaaaagacttagaatggattcttgctctaaaaaaattagatttctctcttcgggaaattcattcgattttgtctctgaaacgaatctcaaattttgcagatgctgaagatttagaagaactaaaagaattattcaaaagtaaacgggacttctgccagcaagaaatccagaaaaaagaagcggttataaaaaatttagatgctcatatcttacgcatggagcaggcaaaaagaaaagaaaaaagtccaactggtgttcctgttaaagccctttccattttatgttgtccaaaatgtggtgcttctttttccatgcaggatgtggaaatggaccagcgttttttatataaaggagcactgtcctgtaaatgcggttattatgccaaaatttcttctggaattttaatgacaccaaacaaaaatcaaaatctgcaggacacacctgatttgactcgcgagctttataaagatttgccacccgatttaatcagcatgttcgagcgttcttataattggatgttagaaaaaatgaaccaagtcaatcttcatggaaaaatcattgcagaaacttatatcaatgcctggttttttatgcacaatcacttgcaggcgcttccaacagacagcctttacattgtcattgataaatatccggaaacccttttaatgtataaacatttaattgaaaaacaaaagccggaactcgacattttatatattgccgattctagcacgaactttccgttaaaaaaacactgcattgatttacatctggatttctttgctgcaaatgaacataacttttatcatgatacctttttatataaaagaatcattccatttttaaaagaaaatgctgacctgattggaacttatttttatttttctcatgcacaaaaatccatgcgaaccctgctttcccagtatcctgaatgtagtgcaaataatttttctctttcttattttaaaaactcacttgcagaatctggctttatcttaaaagactgtgaacctttagatgctgtaactgattctggaaacaatcttggatttggttttcatcaaaaaggagaaaaaatgtatctgatgccttattatgctcaaaaaaccggccagtagtttctgaccggtttttctttccatccatatttttttcattcttaagcgaaaaacttccctgctgcctgaatcagataccaggtatctttaattccggcagtctcatacggagagtgcattgcaagctgtggaagtccgatatcaactgcatttaacgcaacttttgttgttgagatatttccaagagtagatcctcctaagatatctgaacgattcgtaaatacctgatatggtacatctgcttttttgcagatatctttaaacattgctgctgaaaccgcatccgtacaatatttctggtttgcagaatatttaattacaattccttcattcagatatggacggtttaccggatccgccacatcactgtaatttggatgaacggcatgtgcattatctgcggataacataaagctctttgcaagatttctgacataatcttcataagaatattccatacattcattgattcttaccagtacatcatacaggaaagtagacgctgctccctgttttgttccactgccgacttcttcattgtctaatacacagtgtacggccagatgtgcttttttctcaccttttaagaatcctttcaaagaagcaaacgcacactgtaagtcatccagtctggaagaagaaacaaactcttcctttgctccccagattgttccttttacacgattgtataggaataaatcatgtgctaagatatcatcttcctttactcctgctgtttctgcaattgttttcataaatgtatctttagaatcaatatctccgtaaagcggaagcatatctttctgtgcattgtatttataaccgtcatttacttcacgattcatatggattgccagatttggaagcatcaataaatcccggtctacatttaccagttttgtgacaaattcatcgttttcgtttacaataattcttccggctaccgaaagtggacgatcgaaccatggagaacaaatcattccaccataacgttctacatttaattttacatattttttatctacctgcatttccggattttctttaattttaaaagttggagaatcgctatgacttgccatgattcggtaacctgaaaattcgtcttccggcattacaaatgcaatgatagaagaatcatttcttgtcacataatactttccacctttttttaattcccatttatctgcttctttgatttcttcaaatccttccatatcaagcatatctttcatggtttttacagcatgaaagcaactcgggcttttttcaataaattcaagtaattcttttgctgtttctttatacattttttcttcctcctggaaatcagaaaagccatgaaacttccctgcaaattcctgcacacagcaagactttcacgcagaaatctcatggctttccgtaaataaaatttattttttatttgtacgtcttgcaatcatcggcatgataaagccaagtccaattagtacaaatggtgttacaatatttaagataagctggaatctgtcttcggaatagatacccataatacatgcaaatgctgtaaataagaagcaccatccaccaaatatcataccaactgtcttattctttacaaaatgatactgagccgggaatttatctcctgcttttttcagtgcaatatatgctacaaatacccaaagataacggagtggcatacaaacagagtttacttttaccagccagcgaaccagtgtatccacactgtcaataccaaatgccggtacaataatcagaatggaaacgattaccataactagtttatgtccatttgtgtaagtaccatattcattttgtttaaacattgcttttggaatataattttcatctgcacaatccagcagcatacgaagcggtgcatcaattgaaataatcaataccgtaaactgtccgattaagttacagattgcatataccactacaaagaagttgcccaatccataatactgacctaatgtctggaatgcgtaataagcaccatttgtcataaggtcttccggaatattattggaatcaaacatcatacccattgcgattgttccaagcattgcgcacacagcaaccataattgccagtgcaatcatacccttcgggaaatctcttgctgggtcttttgtcttattaacatatggagaaattttctcacatccacctactgcgaacaccagaatggataaatttaataaaaacttcatatcaaaagatggcatgaatgttttcatagaccagtcaatatctaacacatttgcatttgtaatcgccggtgctgccatcatcattacgatgaataatagggacatgataaacatcgtagagcctgccaacgtagacagtttctttaatacattgatgcctcttgacgctacccatattgcaaataagaacagtaccagacatgcaatctgaagcacttttgtatttacagaactaatacggttatctctaaaaattgcccaactagctgcgataaaagatgcatttggcttctgagaaatgtacggcatatgtacaacccaatatgtccaacctgcaaaataagcaactttcggaccaattgtctcatgcacccaagaactcacaccaccacctgcatctttgaatgcacttcccaattcaccaaccataagtgcatatggcacaaagtaaatcgcaaagataatcacccacgaaataattgcttttaagccgccatactcagaaaaaccattgatgacattaccaaatgcccaaactgtggagaatgccataaaagcaagactgtaccaaagaatttttttgtcacttccaccttgtttcattgttactttccctttctttaactatactttgctattctgtttttaataacaacagtttcaatacaacataaataattatacattcaaagctgtcaaaaaagtgacaaactttcctacttttcgtcaagaagttccatggcaatcttttccggtttaatcggcatctcttctacacgaagaccgactgcattgtaaaccgcattggcgattgccggacacggagtatcaattacaatttccccgattgattttgcaccgaacggatgactcttttcataactcggcttaaattcaacccgaatttttccaacatcgagacgacttggaatcttatactgcataagagaattattcgccattgcacctttctcagtatactggatatcttcaaataacgccataccaattccctgtgcaattcctccttcggtctgcactctcgccaaatttggattaatcggtgtaccacagtctactactgcaacataatcaatcaattctacacttccggtttctttatcaatctcaacttccgccattcctaccatgtaaggcggcggtgaaatctcagcggcacagttttctgtcacctgaagtgcatcattatttccaaatgttccccgaactccgatttccggaagggttacttttgccgatttgtctttcttttctacacattttccatcaaaagttacttcattcggttctgcttctaacatggaagctcccatttttacaattttttctcttaagttctcagctgcttttgccactgcttttcctgtgatataggttgtagaagaagcgtaggaaccagaatcataaggggaaatatcggtatctacaccaaatggaacaacattgttcaaatctgttcctaaaatatctgctgccatctgtgacaaaatcgtatcacagccggttcccatatcggttgcaccaagtcccaacgtataagaaccatcctcatttaattttaaagttgcaccaccaacgtcaactttgaaaattgcagaaccctgcattgccatagctacgccaacacctctaacttttccatttggaagttcttttctcggatacttttcatcccagccaatcatttctttggcacgttccatacattgatccaaagtacagcttgtagcagtcggagaaccatcataagcaataaatggatccccttcacgaatcatatttttctcacgaatcacagtcggatccatacccatcttttctgccagttcactaactgcggattccagcgcaaagattccctgtgttgccccataaccacgataagcacctgctgccatacgatttgtatacacaacatcatatccaaaacgatatgcctctgtatttcgatataaaccaattgacttatgtccggataaagcaaccgttgtcggtccatgttctccaaatgcaccagtattcgataaagtaaataaatcaattgccagaatttttccttcttcatctgcaccgacttttacttttacttccatttcatgacgcggagacgaacaaatctgagattcataacgagtgtacaccaattttgccggtcttccggttttaattgtcacaattgccggataaacttctgttaccagggtctgcttcgctccgaaaccgccaccaatacgtggtttaattacacgcactttagaagcgccaattccaagcgcacgacctaaaattcttcttacatggaatggaacctgcgtggaagaaacaattacaagacgtccaaaatgttccagataagtataactgcggaaagtttccatcattgcctgctgatttgcttttgtatgataagttttctctacaacgtatttacatttcgcaaatgtttcttcaagatttcccattccttcttcagaagaagcacagagatttcgtttattatctgcaccaaccgggaatctggattcccagttatcttccggatgaattaaaattttattatcttttgcatcatgaaaatctaaaatagcatccaatacctgatattttacttttatgattttaagcgccttatcaactgccgcttctgtctctccagccacaatcgctaccgcatctcccacaaaacgcactctctggtctaaaatcagacggtcatacggactaaattccggataagtctgacctgccattgtaaaacgatcctgtggtacatctttataggtaagaatgcaagcgattccaggtactttcattgctgcatctgttttaatttcttcgattaacgcatgcgcatgcggacttcttaaaagtttaacaatcagacagtccttcggtgcaaggtcatctgtgtagaccggctgtccggttaccaatgcttctgcatctttttttctgactccgctatttacatatttcattaggcttctcctttctctgcttttttatgttccagaaattttaaaatacttctggtttgtcccataaatccagaacaacggcacaggttgccagccagatattcgttaatctgctcttctgtcggattctccagttcttttaacattgcaaagatattcataataaatcccggattacaaaagccacactgttctgcaccttcgtctgctaaaaagccaccaaactctttggcttcttcctgcattccttctaacgttacaatctttttgccatccgctctggctgcaagcatactacaagataagaccggcttttcgtccataagtaccgtgcacagtccacagtttgcggtttcacaacctctttttacactataacaccctttttgtcttaataaatctaataataataaatccggtgcgatttcttcctgtactttttttccgtttaaaaagaaattaattttcatttgcatctccttccacctgtacaagtgctctctttgtcagtacctttactaaatggcttcggtattcggcagatgctctcatattgctgccggtcggaaccagtttctgcacttcttctgccagtgcctctacttcttctactttaaatttaaaagaagattctaactctttttcaatcaacattgctttttgaggtcttgctccaattacgattctgactttcttttcttctaatccaactgcacaagtcagcactggaaaatcagtcgctgaatttctctgacttaaatacaccgtatgcatcggtactttttttacaataatgcgtaccagaatatccctgtctttcttcatctgggcaaattccttcattggaataattccacccttataaagttctacataagaatccatcgccagaaacatagtcagtacatcggaaaaaccatatctcccaaaaatacttccaccaactgttgcacagttacggaactgaactcctacgatatgtcttacactttcacacattgctccatttgtataatcagccagtcctttatgaagctccagactgcgaagcgaagtcatacaaccgattctaaattcattttcatcttcctcaatagtatcaagacctaaaccggataaatcaatcgccatgcttacatttcgatttcccatctttaaccagaccataccgccgataagacaggctgttcttttctgatttaactgatatgcctcttcgagactttctacctttgtatactcttttattttcagcataataatcctttccataaaattatttgagtcatttgattttatacaggaaaaaagagtctgaaattcagactctctcccaagtaacattgtcagtaaccttgttcttcttttatgagtatagcatagcaaatggcacaaatgcaacccagtttttttaacattttcagtcattgacatttttcgtaaatcctatacaatatacaatagggtataaaaggaggataacttgagtgttaaaaaataaaaaacagatattactaattggattttctgtcttattgctgcttattgttttgattttcgctttgacttttaaaacttcagccgaaaaagaacgtgaggaacaagcttctcttgatgcggtctctgcatctattgatggaactgttacagcaattacaggaaaaacgattactatttcaacatccgatggtgattctattacttttaatatgcaaaaagtagaactcgactgcaacagcggtgttattccgggaaacaatgtaactttgatttatgtaggtgcacgtaatggaacagataccagtaacgtacggctgagaaaaatcattacaaccgatgataactcagaccttttatcagcaaaactcaaacagacagaagaggaagaccaagaagaggaagacacaacttccacttccagttctccaggatatgataaaccaggagcagatgtcgatgttgaattgacaaaagaaaatgttactgctctttacaatgtaaatgtccgtgcagacgccgacggagatgcacaggtcattggagcacttgacccagatacaactgtaacaagaaccggtatctgcagtaatggctggagccgtatcgaatatgaaggtcagactggttatgtgtggggtgaatatttagaagcggatgaatctgattcttcctcaaattcatcttcatctgatagctcaagcagttctgattccaaaaaaagcagtagttcaagttctaaaaaatcaaagaaatcaagctcatctaatgagtaatacaaaaagaagctcaagaacaatcatcgttcaagagcttcttttttattcatctaaaactataaaatttcaattccagctttttcacaagcttctaatgtatgttcatcccagatacttgcctgtacttcacctacatgtgctttctgaagcagaagcatacagattctggactgaccgataccaccaccgattgtcagcggaagttcattatttaacagcattttatggaaagtcagatttcttctttcatcacatcctgcttttgttagctgttcatccagagtttttgcatctacacggatacccatagaagatacctctaacgcacactgaagcggttcatgccagaataataaatctccgtttaatttccagtcatcgtagtccggtgctcttccatcgtgacgttctccggattttaataaatcaccaatctgcatgatgaatacagtttttttctctttgacgaaagcattttctctttcctttggagtcagattcggatataaatcttccaattcctgggaggtaataaaagtgatgtctctacaaagttctgtatgcagattttcatactgatattttacttcgtctaatgcattacagatagattctacaatacgtgtaaccgtatttttcagataatccatatttctgtcttctgctgtgatgattttttcccagtcccactggtctacataagcagaatgtaaattatctaattcttcatctcttctgattgcgttcatatcacaaagaattccttttccaggatggaaattatagcggtataaagccatacgtttccactttgcaagagaatgtaccacctgtgcttccatctttgcatctggaatatcaaatgtgactggtctttccacaccatttaaatcatcattcaatccagacgccgggtctacgaataaaggtgctgttactctttttaattttaacgccatgcagagttttttctgcatcagatttttaatcataccgattgcttcctgtgtctcataagttgaaaggcaggatttataaccttctggtattattactgttcccattctattgtcctccacttttccaagaatgttatcattttagtacaaaatacaattcttgtaaagacaatagggacggcgttttccgattttttatgttagccatattaatattgcacttattattaaaatagcagccacaattaacgaattttttcttctatttgattcaccgtaatctcttaccaatacacacgctcccgcactaatactcattaataatattacgcgctttcggattattggatttatttctcctactgcaatcatgccaatggcaattagcaccaaaatccacgtaagatttcttaaatatttgtaccctctaatatccattagatcactccaatcaaatctgtacgagctgcattactgtaaaaataatatttgtgatacatacgtggtcttccacccactaactcatctgtataataggtaatatccgtataataaacagttggaagagaacgacttattattacatttgcaatagtaattgccgctgctgctccagcagagccaacaactgctacaatcgcagctacaaccgctgccgtatcacttaaatctgcatttaatgtaccatttctacgtgataattcatgagaagcatataagctgattcctacttcagaatttccaatattttttccatctaatattaagttaccactttgtttattataatcaattacgtgctcaactccatttttgttatagctaactcttctcaaaatttcattttcatatatattatacgttatttcttcactatctattttagtttctattgattcatcaaaaatcaaatcattttcggcttttacaggaaaaacagctacatttacaattgatatgatagcaattaaacaaatactcaaaattttcttagctaattttctcatataattccttcttatatatctaaaatagttttttataataatattatactgttcattggaccttcctcctttttctttatatttgtttaatcttttcgtattttctgatattttatcatttgtaatatttttttctttattttaatattttttattgtttttttcaatcttttattatataaatattatctttttataaaaaatacacaaatataaattatccctcttaggcagttttacatacaaaaaaagaaccctttcggattcttcttcatgtttttcttaaacatgtaccttcaaaactacatatacaaaaccgaaaccatgcagacacttgccgctccactgatttctcagtttctggtcaagccctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctcacagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctaattcggtccgcatcacgcctttggattgccacacggtttttcctatgtgactcctccttcgcttgccccgggattccattcccgggttgtgctctccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtattactacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctttggcgcttaaccttgccagcatgcacaactcgccggaccgttctacaaaaagtacgcggttccgcatataaagcggttccacagcttgtaaacacagggtttcaggttctctttcactcccctcccggggtccttttcacctttccttcacagtactatgctctatcggtcactaaggagtatttagccttacggggtggtccccgctccttcccacaaggtttctcgtgtctcgtggtactctggatcctgccttgtcctctttcctttcccatacggggctttcaccctctctggctggctttcccaaaaccattctggtagaatcaaggaatcaattccgcagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagacatctccggctcattggatatttgctcctccccgaagcttttcgcagcttatcacgtctttcatcggctcttagtgccaaggcatccaccctgcgctctttcttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacattcagatgtaagtttttgtaatgccatgaccggtagaactttgttctggaggttgcgagcatcacactcactcttattcatcttttggctgttttatcagccattcaaacacaaaagctttttatgcttgaatcactggtaaaatcaccatttgcttattttattttttgtaatccggcagccacctgctttcccatgccgtctccagcatagtatcatcggccgcttaagtcttaaccatcgtgttcgggatgggaacgggtgtctcccctaagcgcatcgccaccggaaatgtttggttattaaattttagaagttttccttccttaataactcaacagtgaaacacttcttaactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcctccaggttatccctggcagtctcatcagagtgcccagctctacctgctggctactgacaataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccgctggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacactgtaccatgcggtactgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggctatctatcccttttactgttttggttcattgaaccgttctttttaaaataaatgaatgtaaaagaattttcgttttcatgtgtttcactgttcagttatcaaggttcctgtcgttctttttatcagcgacagcttctatattatatcaaagctgtttttgtttgtcaagaacttttttaacttttttcaaagttttttgttgctttcgaactttttaactttttgttgcttttatttcagcaactcgtttatattatcatcttttcagttatttgtcaacaactttttttatttactgataatatagtcaaagttctgtattttctctgtcacttatcagcgacaactctgatactatatcacagttgcacaccatctgtcaacatattttttatatttttttacacaaaaagaaactcttaaaaatggaaacgcatttttaagagtttcttctattattatagtatattagtttttgcttatcagcctttaataccagactgagcaacaccctcaataaactgtttctggaacaggaagaagattacaactaacggcactaccgctagtactgctcctgccatctgcattggatactcggtggtatactgtccctgtaaggttgacagtgccggtccaagtgtcattttttccattgaggtgtttacaatcaacggccacataaagtcattccatgcgaacttgattgtaaagattgcaagcgctacgatacctggttttaccagcggaagcataatctgtccaaagacacggaatcgtccgcatccgtctacaattgctgcttcttccagttcttttggtaatgacatgaagaactgtcttaaaaggaaggtaccaaatgcactaaataagtttggcataaacaatgcaggaatcgtatccagtaatcccattttctgaataatctgatactgcggaatcaagaaaatctgtcccggtaccataagtaccgataagattaatacaaacagtgcatttttgaacggaaagtcaatacgtgcaaacgcatagcctgccatcgaacaaaatgcgatctgtacaagtgtcgtaaccgctgtagaaataatcgtattcatataaactgttccaaatggaatcgcagaggatacaattgtatgatatgcagtcgttacaaagttttccgggaaaattgtcggcggaatcttcatcgcttctccggatgttttaaacgaagttaaaatcatccataagaatggaaatactacaacagcaactccagcaagaagaatcagatggacaatcaaatgatttaagtttgattttttggttttcattctcattctcctccttcttaatcataatttacccattttttctgtccaatcatctggattacagtaaccagcatgattgccaggaaaataaggattgaaattgcggctgcgtatcccttatgaccatagtcaaacgcctgtcgatagaacagcataacaaccgtttgcgttgattcataagctggatttgcttttccgaccatcatatataccgtatcaaatacctggaatccactaatgatagaggtaatcattacaaagaagactgtcggtgtcagcatcggtatcgtaattttgaaaaattgcgtaaccgcacctgctccatcaattgctgccgcctcgtaataagatttactgattccctgcatacctgcaagcaaaataatcatgttatatcccactgtcatccagagtccgacaaccataattccaaacaatgcggtatgcgggtctgtcatccagttatgaccttttccgcctactgctttaagcgcactgtttaagatacccatctgttcattatacatccatttccataccatagctaccgcagctgacattgttacagaaggcaggaaatataaggtacgataaattgattttcctttgatttttgcattcagcagagctgctaataagattgataaaaacaatcctaacggtacagttataacaacatattttaaggtattaccaaatgttctccatacttctttgtcacccagcatctctttataatttgccagtcctacaaatgtagacatgttaaacttgtttacatcattaaaactaaaccagaagttctggataaacggccagatatagaacaccagcaaaccaattgtgaccggtgcgatcaagacatatcctgcaaaccagtcttttttctgtcttttcgacgctttttttcttggtacttttgctttcacttcagccattctttcacctactttattactttgctaaaagtgcatctgcttcttttttcagtccgctacaagcatctgcaagtgacatttctccattgtaagcttttgtcagccatgtagattctttgtcatacagttctgctgcctgtgcacaaaccggaagtggataagcttcatctgcatggtttgtataagctgctaagttgtactggctgtttgcttctgcgaagtatttctgagcatctgttctggcggagataactacacctgtctcaccctgaatctgctgtgcctcagcacttccaagccagatagcaaatttttcagcctcttctttgtttttagaaccttcatatactgcatatccaagaccgttgatacagttatcttctacaccattgaatgtaggaatttcaacacagttaattttatctttgattgtatcattagatgcatattccggaaccatgtaagaacctgcaaagttcattgcaagctgtccgccttcaaacattgcatctgcagatgtttctgcaagtgtagctgcacttggtgaaagtcctgcatcaatcatatcaatccagcactggataccttcctgagttttttcatcttcgtatcctgtttctgttgcatcatcatttaaaatccagccgccgtttgcgtatactgtctgataataccatgtctggaagtcaaccgggcacgcaaatgcataagtaccttccggaagtttgtcttttaattctgttgccagagccactaaatcatcataagtcatatcatctgtcggatattcaactccagcctggtcaaacagttccttgttataccataatgcgtttgtatcgaagtctttcggtactgcatagtttttgccctcacgaacatagttgtttaccagtgtttctgaaaaattgtcgttgatgtcagaatcagcgattgccgaagaaaggtcatctaagattccaccttcctgataagcatccagatgcagtacgtttaaccagaatacgtcaggagctgttccgccgcctgctgctgcttctaattttgtccagtattctccacctttgtatggtgttaactgaattttaactgtcacgttctcattttctttttcgtaagcttcaatcagtttttccattgcaggtctctgattttcatcccagataccgaatgttaattctgttttaccttttgatgaaccgcttttttcatcagaagaaccgtcactgcttgaaccgcatcctgcaagcatgcttgcaccaaggattgcagtcattccgaatgctaccatttttttcatgtttttcataatacttctctccttttcttattatgattgttctgtttttacagctatctatgaaaacggttttccgttttacatacttcctttttgccggatatcatccagctcaattacggctccgccgtgtaatcttgattcctccgctgcaagagcacagtaatgactctctacagatttttccagtgaagtaatagaaggactctcttctctgtttccaagtaagatatctacaaattcttctaccattacaatatctccaccgccatgtcctgaaaaatcatcggataattcagaagccggaatcaattctgtttttaattttgccccaaaaagtgtagtttcaatgaaatcatcttccacatcccaggaacccattgttacattcatttcacctttcgttccacaaaactgtgcatgtcttgcaaaatcagcagtgtgaccattcatggaaaaactcattgttgaaccgtctgtcatatttaaatttacaacctgatggtctactacatcgttatcacaatgataaacgcatcttccataaggtccggttttcaatgcttcttctacagattccggtgtcggaatttctgtaacaacatctaacggccagcgggtatttccatttcttgctccaattctctcactgtccagataaatgctttctgcatcataaggacaggtagcttttactttgcaaccatcaagacacctcttcgtacatccctccggtgcattttcttctttaaataaatacgtgcttccaaaagaagataaggatttacattttttatctgccagccacagatataaatccatatcatgacagcatttctgcaaaatcattggacttgacagttctttatttctccagttacctcttacaaaactgtgtgccatatgaaaccatcctacattttcggatgcattgatagaaacaatatctccaatcacaccagaatccaggatttcttttactttacggaaaaccggtgtataacgtaagacatgacagacaacaactttgcggtcacattcttttgctacttctacaatttcacggcactcatcaagatccggcgaaatcggtttttccagtaacagatggtatccctttcttaatgccgggattgcctgcgctacatgctgtctgtcctgtgtcgtaataaacatcacatctgcaagcttctcttcttttaacatttcttctgcacttgtataacatctttcttttggaacgtgatattcctccgctaccatttccacttttttcggattgacatctgcaatcgcaacaatctcaatcttatccggatggatttttgcagctttggcataagtatcttttccccggcttccaagtccggcaagtgcgactgtaattttatttgccatttcttcctcctcttttcttctgatgtagccttaaaatctttctgtattcatatcaagctgtttcaacccacaattgaatgaaattgcttgtgaatcaaagaaaagcgggtagaaacagctatccacaataataactgtttcttatgcccgctttggctccgctcatttttttgatttatctgctttcggaaacaatttcataactctgttttctgaaatcaactcttacttttgtaccatcagaaaaacttgtttcctgtaccatgtaatccccattcaccatctcatgacgcagcatttcacattttgcaactttttcatgtaaatcagatacgattttactgcgctcgatattttctttcagactgagttttactttatcatcaaatgcaccatcaaaattcggatatgcagcatcacgaatcagatacggtgctccgccgtttaacagggcataaagcatataatcatcttcatcgctgaccttatccatcatccatggttcaatcacacaatcatgataaaccagattgtataacggaaccggaacgccctcttttggagttccgggctgtctcatcataaagtcataaggtgcataatggcagaaaaccaaactcggaaccgcccagtcactcacttcttcagaacttggcaggattccacaagaaagcagatactcaaagcattttcctctgaattcatagcagtctcttctggtcatgcgatgttccggattatcacattcatcaccttcattacaggtaaatacgtccagatacgccccatctaattctataccatttcgttttatttctccaaaatttcgttttacataatagcttgcctgtgtcgcacacagataagactgtggaccgcctgcccatctttgatgcttcggaattgttccatccggcagcctgcatgcataattttcatcaaaacttggcgccgccaaataataatcacggtactgatcatggattccaaacatatagccacactcatgcatggtatctgcaagctttttcatgccgtcccaaccaccggcttctttacatgccggaaggtaatccggatgtttattatcatatcccggttcagcccagccgtctaagtgaagataaagttttttcactccggcctcatgaatttcttttatctcctgcacacgtgtctcaaacgttgtcaggtgattatttttatccggattttccggatcaaagaaatcagaattttcctgtacctgagttttgattcctttatgtacaaatgcacatccgattaaatcattaatggatggatttctcattgctttttcagacaaagtacgaagccttccctgctcatttacataccctctgtaaattttacaaagagtattataatcgcagtccgatgcaaatgtataacgcataattctgcgataatccattttgccaagacttggttcaaaataaacccctacgtgtgtatatggtccattcgccggatgattggcataataacctccgttccatggtgtctcacaaattgcaatataaccttcccgctcttttacctgaccaaaccacggcatataaccgcccgcagtttcaaaaaatccattaaacggaattgctcccagctccgtttcccagtcatttggaatgagcacaccctgttcatgtgtcagcagtgtataccattctttgcttggatttgtaaattccattgctccaggccagaacagctttttaatatgaagtccttcttcttttaaaggaatccattcaaaatacacatgtccggttgcatcttcaatccagattaatgtttcaaagctgtatggatatttttttccttctttttcaaaatcagaaaatatacttctgattccgactccgattcccgtctgatacgtttcatgagaaattgaagctgcctcgtcaaagaaaagctctccttcctcacattccatatatggacggaatccttctttccaagaccactttgtcttttcttgttccagtgtcaccatcagacttttttcgtccagactgacagctactgtcccctgttcaatttttctcatagcgtaatcctcaatttctacttttttctactcttttcatcacctttaaatataattaacagtatatacagtttttcggtcaatatgttgccttattaaatacttttcttgtcttattgcatactttttgttaaaatatccgcaggaggaatacagatgacctacattaaaaccacattgaagcgggaaatcgcaatcgattcgattatcacaatccactattttgaatacatgaaagactttgtctttcacggggaatctcatgatttttgggagtttctttacgttgatcagggaagcgtcattgtacaggccggagaaaatcatttccggatggaagccggcgatattatttttcatgaaccaaatgaatttcatgccatacgttccgtcggaaattcttcgcccaaccttgttgttatgtcctttataacaaactctcctgccatgaatttctttcggaagaaaaatttcaccctgaataagtcggagcgcactcttgtctcctgcattttaaatgctgcacgtgaagcccttgccacacccctgcatctgccctcgattgagcaggtgaaactcaaacccaatgcaccatttggctcacagcagatgattctgctctatctcgaactatttttaattacactcgaacaaaattatcttccgcttgatgcaaaaccaccagaacgaaaacgacattttccacttgccactccaatcgaattgtctgatacaaaagcgcagagaatcgaagaaatcattcaatatatgcaattttgtatctgtgaacagctcaatacgaaccagatttgccagcatttttccatgagccgttcctctttacaaaaactctttcaaaaagaaaaaggctgtggaccgatggaatattttaatcgcataaaaattcagcgggctaaggcaatgattcgagatggaagtaagaattttactgaaattgcaggatttctttcctacagctctccccaatatttttccagacaatttaaaaaatccaccggtatgtcaccgatggaatatgcttcttccgtaaaaggaatttctcaggcattaaaaggggatgattagaatctgctctaatcacccctgcttttattttccaaaacttttttgttttcttaatttcacttcttattttacacggaatgctacgacactacatgccggaattgtaaatttcagccctttttctgtgatttcataagcagtaaatgcttcttctgttacattttccggttcttcaaatgtattgtaagcatgcatttcctgatttacaatacttgcactgacgtcggatggattcaattctgtaaatgccacttctacttcttcactgtctgttgtagaaagattatttaaggtaattgtaacaataccatctttatcgattgataccgattcctgtaatttcggcacctgatattctttttcccctgcatctaaagtagagtttcctgtaatacagctttctacgaggtctgcatcctgatggtgacgatactgatggaatacgtgataggttggtgttaaaatcatcttttccccttctgttaaaataacagactgtaatacattgaccatctgtgcaatacaagccatttttacacggtcacagtgtttattgaagatgttcaggcttaaacctgctactaaggcatcacgcatcgtattctgctgatataagaatcccggatttgttcccggctctacagtaaaccagcatccccattcatctacaatcatgccaacctctttttccgggtcgtactgatccataattgcaccatggcggttaattaactcttccatgtacagagctttccataaagttttgtaccatactttttcatcaaaatcagttgcgcttcctttaatttcccatccttccggatgtacataataatgaagagaaagtccatccatgaatccatgagccattggcggctgtggtgctgcataacaagtttttaatacgccctctgtccagaaataatctgcaacatttgcacctccgcagactttcttaatcggtgcggaattgtcataatgacgaacataagtctggtatctgcggtataagtttgcatagtattccggagtcatatttccaccgcatccccagttttcatttccgacaccaaagtaatcgattttccacggtttctcatgtccgtttgcttttcttaaatctgccatcggagaaacaccgtcgaatgtaatgtattccacccattcgctcatctctcttactgttccgcttcctacatttccgtttacataagttttacaccccaactgttcacataattcaaaaaattcatgtgttccaaagctgttatcttctaccacaccaccccagtgtgtattaatcattttctttctgttttctttcggaccgattccatccatccagtgatattcatctgcaaaacatccacccggccagcgcaaaagaggaatccgcatctcttttaatgcctctactacatcggttctcattccgtttttgtttggaatcggagaatcttctcccacataaattccttcgtaaatacatcttccaagatgttctgcaaaatgtccataaatttccggattaatgtgtccctgtttattcttttcatttacatataattttgccataaaatcctcctgacttttactcctgtactctcggaattttcacctcagtcggtaagcttccgacttaagatagctcctccatgggatgcgcatctttcttctttccatcactatattggatgttgacttcgattgcaagtggtttctgaattttttgctgatttcgggcttttttgccccattttccatacaagtcgtccaacatcctataagttgtatgtgattttcgtcaaaaaagaagccctgatacaagttttttcactaacttgtacccgagcttcttttcttagtttttactcattctaaatcactgtcaagcggatattcgcaatccgctttcgctatttggttaaaaaatcctaatcttaagcatttaatggatatttatctgtcagctgttttacaatcgcttttgcttttccaatattttccttatcttttaccataagtgcaattgcctctgcaatctggtccatatcttcttcattcattccacgtgaagttactgctgctgttccaagtctgacaccacttgtcacaaatggagattcagggtcgtttggaattgcatttttattacaggtaatatttgcttcatcaagcagattctccattacttttccggtaattcctgttcctcttaaatcaaccagcatcaggtgattctctgttgttccggaaacaatgttaatgcctctctttaagagtccgtcgcacaatgcttttgcatttttcacgatgttctgctgataaactttgtattccggtgaaagtgcttctttaaagcagaccgcttttgctgcaattacgtgcatcaaaggaccaccctgaatacctggaaatactgctttattaaaattaaactgttttgcaatctcagcactgctcataatcataccgcctcttggacctcttaatgtcttatgagtggttgtagttgttacatgcgcataaggaattggacttggatgtacacctgctgccacaagacctgcaatatgagcaatatcgaccattaaatatgcgccaacttcatctgcaatctcacgaaatttcttaaaatcaatcacacggcagtatgcacttgcaccggctacaatcattttcggttttgcttcaagtgcaatctttctgacttcttcataatcaatcacaccttcatcattgactccataaggaacaattttaaaatatgctcctgagaagtttgccggacttccgtgtgaaagatgtccgccatgtgcaaggttcattcccattacggtatctcccggcttcagcatcgcaaagaacactgccatgtttgcctgtgcaccggaatgaggctgtacattcacatattcgcacccgaagagttctttcgctctctcaattgcaagacgttccacttcatctacacactcgcacccaccatagtaccgttttcccggataaccctctgcatacttattggttaaaggactgcccatagctgccataactgccttacttacccagttctctgaagcgattaattcaatatgggaattctgacgttccacttcatctgtaatacacttcgcaatttccgggtctactgcctgaatctcttcaaatgaatacatgttttctaacctcacctttcttatcatttcattctttacttttttaccagattcttcgtattgtggatatttgtttctctcacaaagacattctctgtgtaaaaaaatgcccagagccggaatcgaaccagcgacacgaggattttcagtcctctgctctaccaactgagctatctgggcttgtgcgaaattttcttgaatttcgacaacacagccatcttaccatactctatttaaaatttcaagccccttttttaatttattacgttaaagtcaagcggacattcgcaatccgcttcgctacttgctcatgaacgcagtcgcttagtgctctgcgcacttgaagcgggggaatgcttatctgcgttcaaaaactttttatttcccccaaaaaccctcctacttttccacctcctgtgaaatgttgtaattatgcataaaatgtggtatcctaaccacgataacacaaaaatttttaacgatacaagggttaatgaaattatgatgaatatacgaagattaatagccatctggagcggtcgtctgattaaaaccgcctgccagattaccggaaaacagggtgttacgctcgccggaaaagtcgcactctccatctatccgccaatcttaaaagaactggctgccgaagtgcgaaaagacacttttattgtatgtggtacaaacggaaaaacaactaccaacaacctgctttccgattttctcgtctcaaacggaaataaagtggtctgtaatcacaccggttctaatatgttaaacggtgtagtatctgctttcgttttaagcgccagattaaatggacacttagatgcagattatgcctgtatcgaaattgatgaagcttctactgtccgtgtgcttcctcatttcaaaccggactacatggttttaactaatctatttcgtgaccagcttgaccgctatggagaaattgatatcactatgaatctactctcccgcgccatgaaaatggcaccaaatatgaagcttttagtcaatgccgacgattccctttctacttatctggcaatggataataaaaatccatataccacttacggaatcagcgaacaggtattcaaagaccagaattccaaagaaatccgtgaaggtcgtttctgtaaacgctgtggtcacaaaatggaatacaaattttatcattacagccagctcggggattattactgtccgaaatgcggattcaaacgtccaaaaccggaatttgatgcttctcacattgatatgtccgacgggcttgcttttgatgtaaaagcttcccatatcaaagccaactatcgtggattttataatatttacaacattcttgccgtatttggcgcagcttccatggcaggaatcccaacaaaaaactttaataaagtgcttggagattacactccgcagtttggacgaaacgaacagttttttatcaatggcacgaaagttatgttaaaccttgccaaaaatccggccggatttaaccagaacatcggtgcagttatgactgataccagtccaaaagacattattattctgatcaatgataacagtcaggatggaacggatgtctcctggctctgggatgttgactttgaccgtttaaaagatgccaatgcaagctctatcaccgtaacaggaattcgaggagcggatatgcgtctgcgtctgaaatatgttgacattgcttctgatttggaaaacgatattgaaaaagccattgaatccaaaattaaaaatggcacaaagaatctttatgtactggttaattacaccggactttactctacacacaatattttaaagaaaatggagggaaaaaagtaatatgaagcttacgattggacatttatatcctgaccttttgaacctctatggagacaggggcaacatccagtgcatgatgaagcgctgtcaatggagaggcattgactcagaaacaattgagttcaccttagaagataaaattgattttaccaaacttgatattgtactgcttggcggtggttctgaccgtgaacagatgcttgtatgcgaccgcttaagaacgattcagaaaaattttcatgattatgttgaagacggcggaagcgtcattgcagtctgcggtggttaccagctcttgggacattattatgataccgatgagggacgaatcgaaggtctttcccttgttgacctctataccgaacagggaaatccacgtctgattgacaatatcgtacttcaaaatgatgcctttgagcatccgattgtcggatttgaaaaccatggtggacgaacttacattggagaaaaccgccccttcggaagagtactttatggtcatggaaataatggagaagatggcacagaaggtgtgctttacaaaaacgtggtcggcacttatctgcacggaccattgcttccaaaaaatccacatatcagtgactatctgattaaaaatgctctaaaacgaaaatatggcacggatgaacttacaccacttgatgatacacaggagttagaagcaaatgcttcgatttatcagcggtttgtaaaataaaaaaagatgtgggaaacctttgaacgaaactttaaaggtttcccgcatcttttatttattctgtttctatttactttattttttctcaattttccgaagtaacggaagtgtaaatttcgcatcaaagaacgaaataaacggacctaagcaaaatgcacttaacagtgtaccaatcccaacgattcctcctgccagaaaacagataagcgcacacaaggcatctgtcgaaattctgtgccagaaatatgaaatcgatggtttgcgcattgccataatcagcgacatactgtcataaggcgcagcgccaacatccggtgtctgatacatggatacaccaaaactgcacacaactactccaatacagacaacgattaacctctgccacatcacttccggaattccaattccgttactgagcagattataaaaaaatgtcactatgtatcccaaaaacaatgcgttgactaccgttccggctccgatgaattttcgaccgaaaataatttcaatcacaaaaaccgccagattaatcaataccagaaaattcgcataagccattcccacgctgtctgaaagtgccattaccatcccgctgtacgggtcatttccaagaccggaaagtttaaaaaccgcaatcccaagtcccaaaaagatatttcccactaccataaccagaagccgtccccatccggctttttcaaaataccttcttatcatttttctttttactcttctttcatttttttgactctgttaaactcttctaagatttctttttccggagcttttgtacacaaactgaaaatcacaatgcacaaaatgctgattacaaaaccagttgcaagagagtataaaccagttgcaatacccagagtctgtccattaatgaacggaatataatcccagataataacggttaatcctcctgacacgattccggcaactgcgcctgcaaaatttgttcttctccaaaacaatgacatcagtacaatcggaccaaatgcagaaccaagaccagcccatgcatttgataccagtcccataatactgttgtccggattccatgcaattgcaaatgccagcactgcaaccacgataacggtgacacggcttacttttaatactgttttttcatccgcctgaggttttaaaatatctttataaatatcttttgaaacggaagacgcagtgactaggagctgagaatccgcagttgacataattgctgccaaaattccacataagaataccccaccaataaacggcagacgtaaatcctgtgtaaatatctttgtaatcatctcaataaatacactttctgttgaagcctgaccttccgttcctaaaataaccggatacagataagctcgtccaagcacaccgattgccactgctgcaaagagagacagtgctacccatataatagcaataactcttgattttttcaattctttttgattctttacagccataaaccgggtcaaaatatgcggcattccacaatagcccagtccccatgcaagctgagagaaaatttcgataaaagaataagaactttctccatttcttgtcatgcttaaatatgcctgatgtccgccaatgacctggctttcatctaacatggcatttaaatttccacttccaataaaacaatacgcaagcacaggtacggcaagcagcccaaccagcatcagacttccctgaataaaatcggtcacacaaactgccataaaaccacccataaacgtgtaagcaagaataacaactgctccaattgcaagtgcaatgtgataatcaattccaaatacggaatgaaataattttcctccggctgataaagcagatgccgtataaaccagaaagaatattacaattacaatcgaagatactaaaagtaatacacgttttttatcgcgaaaccggttttcaaaataagccggaagtgtcaatgaattatttgcaacaattgtataccgtctcagacgagaagagatacagacccagttaaacaccgttcctaaaaacaaaccgacagcaatccatgcctgaccggttccaagtgcataaacggttcccggcaatcccatcaagagccagccactcatatcagacgcctgtgcagacaaagcagccacccatccgctcagtccacgtccaccaaggaaataatcttccgagttttttgttttcttcatataaaccgcaccgataactaccattaatatcaggtaagctgcaaatgccgctaatacgacaacaatatcattctgtttcatcttttttctccttattctgcttctgtcttctgcacgcctcaacctttgacggcatgcatcaaagattggtttacttctgtttctgtgcttttcgacgtccggaaagttctgcaactgcagtataaagaacgtctgtagaagaatttaaggctgtttcacaggaatcctgaatgactccgacaataaatccgacaccaactacctgcattgccaaatcattggaaattccaaataaactgcaggcaagcggaaccaaaagtaaagaacctcctgctacaccagatgcaccacaggcactgactgcggataatacacaaagaataattgctgttggaaaatctacagaaattccaagcgtatgagttgctgcaagcgccagaatagaaatcgtaacggcagcgcctcccatattaattgttgctccaagaggaatggaaacagaataagtatctttatccaaaccaagttccttgcataaattcatgttgaccggaatatttgcagcagaacttcttgtgaagaatgctgtgattccactgtcttttaaacatttaaatacaagcggatatggatttttacggattccgatataagtaatcagcggatttactaccagtgctacaaataacatacttcctactaaaaccagaatcaaatgtccataactgagcagagcatcaattccctgctctgaaattgttgtaaataccagccccataacaccaaacggtgcacaactgataatccatcttacacactgagaaatcgcatcggaaatatcagtaattgcctttttcgttccatcccctgcttttctaagtgcaattccaagaagaaccgcccaggaaaggattccgatataatttgcatttgcgatagcatcgatcggattggatacaatattcataaacagtgtctttaaaacctctccaaccccacttggagcactgacatcctccacacctgctgtcagggtcagttccaccggaaacagaaaacttgctatcactgcaaccgtacctgccaaaaaagtaccaagcagatataatacaacaacggttttcatatttgtcttttttccctctttatgctgacacaacgcaccagacacaagaaagaataccagaatcggagcaaccgcctttaatgcaccaacaaaaagctgtcctaaaagcccgattacggaaaactgcggaacaaccataccaagaataataccgataatcaaaccggcaataatcctttttaccagactgatgctgttccactttgtcacgagttccttcattttgtcttttctccttttttcctctgtaccctcgctctcctcatatcacaaaagtacatcgctttatcaatattcgctcatcattttatcacaatcggctcaagaagcaaagcattttgtctttctccgcaaaatttttgtccttgtaacgaaaacacgcaagattctctgtgtattttcgctgttttttcgtgtttcttttagagcgcgagacgttgcagaacgtccggtggacgttcgctttgcaacgaccggagcggagcggagacctcgaaccttcgagccccggcggggctcgaaaacacaaaaaagatggtatccaaccggataccatctttttgtgtttcttttagagcgcgagacgggactcgaacccgcggcctcgaccttggcaaggtcgcgctccaccaactgagccactcgcgcaaagagcgggtgatgggaatcgaacccacatatccagcttggaaggctggtgttctaccactgaactacacccgcaggttatttaattgttgctgtctcgttaagacttgtttataatacctcaaattgtttctattgtcaacactttttgaaaaatttttttaatttttttttaaagggactgctgccttatttccaagactgcaatccctctctttattatttatgccagaccatgtacttcaagccaatggtctaatgtttctttattgctcttaattcttcttgcacgaatctggaatacaatcaatgtaagcaaattaaatactacaaaccagataagcagataaatcactgcgttcataatactttcgccacctgcgattgtgcttctgaatgcctctactgtataagtaaacggtacccagtcatgcaggtattttacaaagtcaccggaaacttcaagcgggtaagtaccaactgaacctgccagctgaattaccataaataccaacattaagaaacttccgacttttccaagtgagtttgtgaagaagtacataattgacataaatgtcacacttgccacacaaacaaacgctaatgtcttgccaatttcaagtggtgtaaatccatcaaatacatgcagtaatgcaatcattacaagaccctgtaataaagcaattgtataaagtacagaggctttgctaatccaccaggagaatcctgattttaatttgcctttgtaacttgtcagaggatacattaaactaaatgcgatacatccaacccaaagaccaaccgacatcatatatggtgccattgcgtgtccgttgttttctacggttgtaatctttgtttcacttgcctctaccgggcttgagaacatgtcataagtattgtcgtctgccttggtctctttgacttcttttgctccatccgcaaggcttgttgccaatgtgtcacttccatcataaacttgatcaagaccatcgcctaattcttcacttccgtcacgaagctgtccggctccgtcactaatttgtgctgctccatcactcaactggctgacaccgctaagcagtgtactattatttgctaccagctgttttgttccggatactaaggttgttgttccatcttttaactgacttgcgccatcataaagctgtccgcttccggaagataactgttttgctccatcatctacctgtttgattccgcttgagagtgttcccattccgtcatctaaacttccggctccatcgtctaactgtttgactccgtctaccagtgtcggtacagcggatttcaaagttccagttccttcacttaaactgcctgctccatcgtctacctggctgattcctgctgcaagggttcccattccggtatctgctgcttctgcacctgcgcttaatgcttttgcgccggtgtttgcactctggatacctgctaaaagttgagatgcaccgctctggattccgcctaaggcttctgacttaaactgagttccgcctgctgctacctgctggattcctgctgtcagtgccggactctgttctgcaagctgttttgttccggctgccagtgtctggcttcccggaagaatctgagtacttaatgcactgttaattgttgaaattccagttgtaagtgccggtgcctgtgctgtaatctgctgaacaccacctgtataactatttacaccagtttttaaactgtcacttgctgatttcaatttatcaaccgtaacaattaactgttgtaactgttctgcgcttacttctgcctgtgcagaagttgaagtgtttgttgttgttgtttcaacgcctgccactttgtcaagctgtgcacttgcattatcggctgctgatgaaacgttctggcttgcacctctaagtgtttctgctgcacttgcactctgggatgctacatttgcaagctggctgtttgcgtcatttacagatgctgcatttgcattcgctgctgcaatcgcctgatttgcaatgtctgctacctgattgatatcaccatttgcaacggctgttgccagtgcttctgataatccatcaactgaagtaaccgcttcctgattggtgctgatgcttcctacgctgtctgctgctgatgaaagtgcatctgcctgactctttaatccattcactgcatcttttgcaccagatacatctacgctaacttcttttgttgtgctctgtgaagtctcgtttgctgaagcagttgttcctgccatctgatgaagcattgcggaaagctggctaagaccatcattaattcctgttgctcctgctacaagctgtttggagtttgctccatctgttccatttactttttcaagtcctgcctgtaatgcttttgcaccactttctgcacttgatgctcctgcagttacctgctcgagtcctgccgaaagctgagatgctccattatttaaagctgtggaagattccggaagacttgctgtgctttcctgtaactgattaagtcccgcacaaagttttgccattgcctggtctgctgtactgattcccattgtcagagaagttccaccggcttcaagctgttctgttccggctgcaagctgacttgctccagtttttaaactagctgttccagtttttaattttccagaaccatcaactaactgagaagttccaccctttaactgaactgcgccatctgcaagtgcatacacaccatcctgtaaggttggcacctgtccatttaactggtcaagtccggtctttaatgcactggaaccatcttttaactggccggaaccagatactaactgagaggttccagatgcaagctgtgcggttccggttttcgcagttgcaataccgtcttttaactgacctgctccactgtcgagctgtgttgctccactgccaaccgtactgacaccatctacatactgctttaatccaacttcaagtgtatcactaccatctttaaaagtaagtgaactgtctgctaaaacattcagattttcggaaatggtattatttccatcgactaactgtgtaactccgtcttttaactcttcagagccatctgccgcttcctgcattccatctccaacagttacaatctgatcaaatacagtttctacataagtctttgttacctcttcggccacactgtttttaatcttttccattgcagtttcactcattttagaagcaatgtagtttgttcccggattggtatcataatcgagttccattttctgaggttcttcatccataactgtggatgcattttctgagaagttttccggaatcgtaattaccatgtaataagttccgttttttaaacctctggctgctgtctcctggtctacaaagttaaaacaaagagaatcctcatctttcagcttatcgactaatttctctccgactttaagttccttgtcattgtaggtcaccggtttatctttattgactaccgctaccggaagtttatcaagatttccataaggatcccacattgaccccagaaaaagtgtggtgtaaatcgtcggtattgcaataacagcaattacaaccactaaaagcaacttattcttgaacaagcttttccactctttccctagcatatacattcccctttccttattcagttttctctttcggatatttgttatctttgaaatgcttatcatttctaaaagataattgataactctgtttctttctacgtcaaatcgcttatccgatttcgatttgtttaacgtactttgaatagtttaatagatattgtgttgattttttcttcatgatgaattatactaaaggtgcaacagtgatacaaccatcaataactagtttttatgtacattaatagacattttttatcatttatgttgctttttcttcaaaaacctgagaggagtcttatatatggaaaagaaaactgaccgaagagtccgaaaaaccaaagctcaacttcgtgccggacttgcgaaattgatgcagacgaaaagtatcaaagaaattacggtaaaagaattagttgatgaagttgatattaaccgttctactttttatcttcactacacagatatttaccagatgttagaatcaatcgaggatgagcttgagggggaaatcaatcagattgtaaataatcatcctgtggattcttattacaaagaaagtttccctatgattaaggaaattttagaagtattatgggataaccgcgatatctgcaatgccctgcttggttcaaacggagacatggcatttgtgcttcgtatggaatctattatttcacaacacagcctgcatgttctgactacaacatttgctacagacgtaaccaatattaaatatgcttatgccttttgtctgaccggttgtgtgggtatggtcaaatcctggctggaatctggagatactacagataccccgcttcaaatggcagaattgacttatcatctgattatgaatgcactcaaagatatcaaacgactgccaagtacaactttatagcttaaatcaaacatatacgcaaaaaggttcagaagaaattcaacttcttccgaaccttttcttgtttctttttcattttttaaaaatcaaatgtcgccgttttcgtatttcccatattccatttattacgaagagtcacatacaattctgcatttgttgcttccacataaggttttacatagaatactactcccagaccacaggtcactgcaccaagcagtccccaaagaataaacgataaatccagcacaaatgtattcatcttttctccatccatcatctcacggctgatgcggattgcatcccgataattaatatccggctgttctgccagaatatatggaaccatgcggtaagaataggattttacaattcctggaattacaaacaaaagtgtccataagaaaatatataaattctgcatgaacattaccattgccacatttgcaaaatttccattctgaaatccaaatcctatctttgaaacaggtgcattatagtctcgattttcaataaaaaagcgaactgctccaaccatcaatacatttaacacaaaaatctttaaaatcagaacaaataatgtaactccacccacaatcggcagtgaaatatctgcggaatagctactgtcatttacgacaccattcactgtgcctctgacatcataactgccacctatcgaagctgttgcaattgtaatcatcaaacctgctaagacagatgctgcgtagtttctatggaagcaaagttttcctctttcttttaagtctgctctcgtccacataatcattctccctttttatctcaatattcgacttgaactttattttatctccgctgttgcttctttgagccattctttttcttctttgttttccaacaatggctctactacttcatacacatgtttatgatattcatttaaccattttaattccgtttctcccaaaagttccggaatgattgcttctcgttcaaatggcacaagcgttacgacttcaaagttcataaactgtgcatagtcatttttttctgcttttttgcacatcagcaggttttcacagcggattccgtattttccttccagatacagtcctggttcatcggaaatcaatacgccttcttcaagcggaatcattccacccggacggattccactgttccagttgatgttctgtggtccttcatgtacatttaagagatatccgactccatgaccggttccgtgattgaaatccagtcccgcatcccacagtgcacctcttgccagtatatccagatgtgcaccgcctacgccatacgggaattttgccattgccagacgaatatttccttttaatacaagcgtaaaatgttttttctcttcttcgcttaacggtcctaccgcaatcgttcttgtgatatccgttgttccctgccagtactgtccgccggaatcaatcaggaaaaatccttttgattccacttttgcacagtcctcttttgacggtgcataatgacacattgcagcgtttgatccataagcacagattgtttcaaaacttaaatccagacagtctttatcttcttcacgaaactctctgcttttttctgcagcattgtattcatccactgttccctctggcaccgttttctttaaccagtaaataaatctgcacattgctcttgcatctttgatgtgcgcaatgcgttcattttccatctcaaccgcatttttcattgcttttgccggtttggtcggattcatcgcattgactgtggtaacttcttctggcagattttcaaataatgtatagtttactacaccttcatctaataaaatcttactgtcttttgcaagtgtttttacttcttcataaatcgcaaagtatgggcggagtaccactccggctttttctaattcgttcttgatttcatcagaaaccacgccatcctgcacatagaaaatgacttcgtctgctttcacaatgacataagaaagcacaaccggattgtaaataatatcgtttccacggatgtttaacagccatgcgatatcgtccagactggataagatgtgcacgtcagcttcatattttttcattgctctgcgcaccatctcgattttttcttctctggatgttccaacatattttatatccacaagataagccggttctttggacagttccggacggtcattccagatgccgtctaataagtcttcctgacaatagaaccgtcctcctttgtcttccatcatttttttgtatgcttttccctgtgacacgctgatgactcttccgtcgcaggcaaggcaggaaccttttgccaggttcatttccagaaattcatcgactgtcggaacgcctggttcacgcatcttcattaaagtaactccggtatcttcaagttctttcgctgcctgaataaaatatcttccgtctgtccataaatatgcctggtcatcggttacaagcagtgtacctgctgaaccactgaaaccagaaagccattttctggctttaaaataatcccctacatattcagactgatgaaaatctgctgtaggaaccaaatacatatcaatgtttaattcctgcattttttcctgtaattccaggattctttctctgttctcactcatgttaaaaacttcctctcttgcttctatctcttacttctatttactgaattcctttcatagtaagggaaattcgctttttcttttcatccacacttaacactttgacttccacgatgtctccaacgctgactgcttcaagtggatgtttaatatatcggtctgtcatctgtgaaatgtgtaccagtccgtcctgatgtactccgatatccacaaatgcaccaaagtcgatgacatttcgcactgtaccttttaaaatcatgccttcttttaagtccttcatatcaagcacgtcagtacgaagcaccggttttggcatttcttctcttgggtcacgtcctggttttccaagttcttttacgatatcacgaagggtcatttctcccgttccaagagactctgccatctttctataatcttttacataaaatgcaccatgacctttgaaaatatcttctgcagttgttcccatattttccagaaatttttctgctacttcataactttccggatgcacactggttgcatcaagcggattgcttccccctgtaatacgaaggaaacctgcacactgttcaaacgctttcggtcctaattttggtacttttaaaagttcttttcgactctcaaaacgtccattttcctcacggtatgctacgatattttttgcaatcactttgctgataccggaaatatattcaagcagggaaaccgaagcggtatttaaatcaattccgactttattcacgcagtcctctacaactccagacagggcttcccctaattttttctggttcatatcatgctgatactgtccgacacctatagatttcgggtcaatttttaccaactctgcaagcggatcctgaagtcgtcttgcaatggaagcggcacttctttgtcctacatcaaagtttggaaattcttcggtagccagtttacttgcagagtatacagaagctcctgcctcgtttgtaattacatactgaaccttctccggaatttcttttaaaagttccacaataatctgttcggattctcttgaagcggttccatttccaagagaaatcaggctgacattgtattttttaattaattttttcagagtttcttttgccgacgcaatcttagcgggagtggtcggtgcagtcggataaatcacaaccgtatccaagacttttccggtttcatctaccactgcaagtttacaaccggtacgaaacgccgggtcccatccaagcactacttttccaacaattggcggctgcatcaacaactgctgaagatttttcttaaagactttaatggattcatcttctgctttttccgtcatgctgtttcggatttctctctcaattgcaggtgcaatcagacgattataactatcctcgattgcttcttttaatacgtcctgtgtatttggattttttcttgtaataatctctctttgaagatatcctaaaatttcttctgtcggagcttcaatttttacgcctaaaaacttctctttctctccacgattaatagcaagcacccggtgtcccggcattttttccacacgttcttcatattcataatatttctcataaacagatgtctcttccggtttttttgcagttgaaacaagcatgcctttcctgaaagtacactcacgaatttcactacggtaatccgctttatcggaaatactttctgccacgatatcttttgcaccggaaatagccgcttccactgttgtcacttctttttcttcggatacaaatgccttcgcttcttcttcaagggatttgtctgtcatctgtaataaaataatgtttgcaagaggttccaaccctttttcttttgcaatcgttgctctggtacggcgtttcggacggtatggacgatataaatcctctaccacaaccagcgtctgcgcttctaaaatctgtttctttaattcttcagtcagctttccctgttcttcaatactggaaagcacctgagttttcttctcttccagatttctaagataagtcagtctgtcgtttaaattacgaagcacttcatcatttaaagcaccggttacttcttttcggtaacgggaaataaatggaatcgtatttccttcatctatcaattttacagcagcctctatctgccacttttccacatttagttctttggtcaaagctaaaataatgtccataattttctccttttaaatcaagcaattcttgccatttgctttctttctaaccttaccaacctatgacagttttgtcaagaaaacaaaaaacgcaatgaacttttttattaaaaatccactgcgttttactcctcttgattttgtttttgaatttgatttcgattgcagatttccagacctgcctttaaaaatacttccaattccttttgtaaatcagaatcaaattcctgccatactttatttaaactgctaatgttttgtacatcctcataaaaaacaacagatggcggataacccagattctgatacaacactgccagaagttctgcattaacacctaatctgcctttttcaatttcacgatacctttttgtcgtaatatctaaatgctgtgccatcttatcctgtgtaatatcacttgcttttctcatccaataccagattgttcttgaatccgtctctttttcaaaagcagaataacggagcagtctgatttctttggtataatccactccatttttctgttcttttcccgaaatattgataccctgctctattgtccagaccataagctgtaagaaatcgctttttatttctttcttacagacacccagatagtgatttaatatcgtttcttcacattcctctcctgtcagcagataatccatatcacagccatgactgtcaaaatttttgagttcttctgctgaaataatggtctttccctgttccaacttactatagtggctctgggtaacacccatcatctgactcatgctcttctgattcagttttctcttttgtctgtacatctgcagtctttgcaatactccttcgtatgcactgcccatagtgttacctcatttccaacggtcaaatttttcttatctttttattgtaatatttttcaaactgcccttttatcccctatttttgactattctgataatttttagtcaattttaagagattgacagctttcatcccaaacatttgcctgacacataaggtttctgcgcactttaagcggcggaatgcttatctgcgttcaaacgcttgccctaatcggtacaacgtgttaaaatgagcaataacaatttttttatttttgagaaatgaggtttttacaaaatggataatttttataattcaaatgataattttccgccacagacaccgccttattatgaacagcctcagcgttatcaaggcagttcgagctgtgcctccgcctctttgattcttggaattctttccctgttatcaatctgctgtatgccaccgcttgcccttgtttttgcaggacttgccttgattcttggtgcactttccaaaggcgaccgaatccgtccgcaaaatgcgcgtgtcggcatgattttatcaggtatcagtttaatagctgttttaattttgcttgctgtatttctggttcgattcacttcaaattcgaccaacaccgaatttttcaagcaatatctggacattatcgagcatccggacgattattccgaaaatgacatctacaattttctgtatgattatctttatccaaacgccggttcagattccgatcataactatgaaaattcacagccttatcactacgatcatacgccttatgatggagatgattccgatggctacgactattactatgaatatccgactccacatcaggaagattccgggcatcataatgtaatttaaccaaatcaagcaagtcccttctgataagcgcgtagcagctatttggttatgagcaagtagcgtagcggattgcgaatatccacttgactaaaacaaaaaaatcctgctttgaggaatcgaaaacctcaaaacaggatttttatttttctaatctgatttttccagtctaatttttttattttaaattttcatattcttttgtttccagttcaattaccggttcttcttttttgtcaaactcaccttttaaatccagataaaacgctgccatcgttgcttccatataaggcatcagccataacagaccaatatagcaggtcagcatacttgccagaagcagtggaataaaacttaaattaatatagaaataacgccacttatttcctttcataagggaacagctttttttcattgcatccactgctgataaattgatatcatccaataacagataatccgtaacagccaaaaacagatttaaaaccaaagctactattgtatccacacacattgcaagtacagaaagccagatataagaaatactgctactgtctgtccagagtggaatattaaacggcagaccaattacaaactgtacaatcagaataatcaggtgtacaataataaaacggtctggatgatgcgtaaatgcaaatgccaggtcttttccttcaaaagactctccacgacagatatttaccatcattttactatatccagccttcaacacgctgacaagaagtgaaataacatacactaaaatctgcgaagtaaccagtcccattgttgtaccggtacccatcgtagaagaaataaaaaaagagggaagaaaggaacaaagtccaagcagtaaaattcctgccatcggagttccataatttccactcagttgctgtctcgcaatcagcttaagagaagcagaagttcttttcataaaataaagtctccaatcttttgtaattaactgtttatttcaattgtccatttcaattagtgtaagattattttttcattttgtcaagaaaagaggatatattccattatgcataaacaggaagaaaaaaatctatatctcttagggtggattttactcggaatttttctaagttatttattgatagcaaagttttcccatttcagaaccttctttcatctcccctgtctcttccgtaccctgaccggatattactgtccgggatgcggcggaacacgggcatgtatcgcctttttacatggacattttttacgttccctgctctatcatccggttgttccttatacagcagtcgtatatttgattttcatgatcagtcacagtatcgaacttttatcaaaggggaacttcgccataggtttaagataccgggacaactatattaaatttgccggtatcattattttagtacaatggattttacggaattttttgaaatggaaatggggaattgatgtgcttggaaattaaaaaagaggctgtttttgacagaacagcctctttcattttttacgctttaaaacggattctggagatgatttccggaagttttgctgcttttgcttcgtactctgcttcgcttaacggtcctgtgataattgcaaattcgccttccacatccggaacggatacagtttttactgcaccaaatacagcttttactgcatctgccatttccgcttcctttccttttatacgaaccaggaatggatgaaccacttctttgatatccattaaatctaatttttcactgttccagcttgtcatcacattttcgtgaagatgttttgcacaatctacaacatctcctacaactgcgcttgctgtcggaagttttcctgctccacttccatagaacattgcatctccgagtacatttccatgtacgaagattgcattaaagacatcatttacactgtaaagcgggctgtctgttccaacaagtaccggacttaccatcgcatagaatttatcattttctttcttgcttgtcgcaagcagtttaatgctcatgccaagtgctgaagcatacttcatatcttctactgtgatttttgtaataccttctgtgtaaatctcttcataatttacatggtttccaaatgccagagaggacaagattgcaatctttctgcaggcatcatatccctctacgtctgcttccggatttctttctgcataccctttttcctgagcttcttttaatacttcttcaaaatctgcattctcagcctgcatttttgaaagaatatagtttgttgtaccatttaagataccggaaatctcatcgatctcatctgctgttaaagaagagtgaagtggacggataatcggaataccaccgccacagcttgcttcaaacatatagttaatatttttctcttctgcaattttaagcagttccaaaccatgtcttgcaactaattctttattggatgtgcagacactctttcctgcctgaagtgcacgtttggtaaaagtatacgccggttctacaccacccattacttccactacaatatctacttccgggtcattgataatggtttcataatcatgaaccaaaactttttctaccgggtctcccgggaagtcacgtaaatctaacacatatttaatgttgacttcctgtcctactcttttattaatgctctcatgattggtgttgattacttccacaactcccgagcctactgtaccatagcctaataccgcaatctgtatcatctttcctctactccctacctaagattttcagatagtgaacgccctcgatgtgttcaatctccgccaccattgcttctgcatcaccctgtgcaggcaaaatctgtacacttaatgtaagactggcaattccgttaatcggaatactctggtgtacggtaagaatattgccatgatagtaggcaatcgtttttaatacacctgagagcagtcctggttcatcatccatctgaagaataaatgtaatattctgtcctttggttttttcacgaaaaggaaagatatcatctttgtatttataaaaggaacttctgctgattcctactgcttctacggcttcctgtaccgttacagtccgttttgactccaaaagtttttttgcctctactacttttaacagtacttccgggactgccttttctgttactacaaaataccttttattatctgacattcgcttcccctttgtttgttccaaaaatacatttgtgtttctccaaaagatattaacacattcttgtatttttatcaactatttttcttatttccaagcgcaatccattttagataagcattgataaaacggtcaatatctccatccataactgcatctacatttccggattcctcattggttctgtggtcttttaccattgtgtatggctgcatgacataagaacgaatctgatttccccagccaatttcagttaattcaccctgaataccggaaagtttctgctcctgttcctgctgctttaacaagtacagttttgctttcaacatctgcatcgccttatctttattttggaactgggaacgctcgttctgacactgtaccacaattccggtcggaagatgcgtaatacgaatcgccgatgaagttttgttgatatgctgtccacctgctccactggaacggtaggtatcaattcgcaaatcatcatctttgatttccacatcaacatcttcttcaatatccggcatcacatcacaggatacaaaagaagtttgtctctttcctgctgcattaaacggagaaatacgcaccagacggtgtactcccttttcggatttcaaatatccatacgcattttccccattaatctgaatcgtaacagatttgattcctgcttcgtctccatccagataatccagtacctcagtggaatagccatgacggtccgcccatctttgatacattcgataaagcatgcccgcccagtcgcaggattctgttccgcccgccccggcatgtaaggtcaaaatcgcattgtccttgtcgtattcaccggaaagcagtgtttttacacggattttttcaaaatccgcctgaaattcatcgagcatatcctgaatttcaggaatgaccgaagcatcattctcttcgtatcccatctcaatcatcagctcaatttcttctttttgtgtctctaatttctgataaatctgaatatcctcttttaaggtactcagctctttcatcattttctgggaacgctccggattatcccaaaaatcaggagcttccatttctctttctaattcttcgacccttttttctttgttagcgaggtcaaagtgaatccctcacttccactaatggtccattatagccgtttaatgtatatttaaactgatctaattctaccaatagcttcacctactttcatgaatatttttcttatttttattcctcatcgatttccacagaaaccatataaatggaaatctgtggctcgacttttattaccgtaccgcttaatttcttaagtggacgttttaaattacttgacattgcaatggcatctttaattgtataataatacatctgtccggacatggtactcgcacagtcctcttttaattctactcggtcaccctcttttaccagtccttctctttccattgtaaattctacaatctgtcccatttgttcaccttccggttttttgtttttgcccgttctcttttatctgtatctgctttagattctttttctgccacagcactgtttatattttttaccgcttccacatgggcatgggtcatttggataaattttgttttcttctctttgaatcggctttttcggaccggattcatctttatttgtaccggttacctgtgcaacctgttctctttctaccttctgttcaattcttacatgatacagcagacgaaccgttgtctcctgaatgttgttaatcatgttatcaaacatttcataagcctgcattttgtattcgactctcgggtctctctgaccataagcctgaagtccgataccctgacgtaactgatccatatcatcgatgtgatccatccatttctggtcgattacttttaagaggataacacgctctaattcacgaagctgttctgcttccgggaattctgcttctttttcctcatagagtttgacagcagcttcttttaattcctgttctacctgttttttctttttgcctttgacatcttctttggtcagagcttttaatggaatcgtcggtaagagtacagaattaaattcttctaaatcccattctgcggtatctacatcatcagagaagcacatttctactgcatgttctacggtatctgtaatcatcttatagatagaatcacgcatgttttctccgtccagtacacggcgtctttctttgtaaataatttctctttgttcattatttacctggtcataatctaacaggttcttacgaacaccatagttatttccttcaatcttctgctgtgctttttcaattgcattggaaagcatcttatgttcaatctgttcattttctgcaacaccaagtgatttgaatactcccatcagtttttcagaaccgaacagacgcattaaatcatcctccagagaaatgtagaagcgagattcacccgggtctccctgacgaccggaacgtccacgcaactgattgtcaattcgtctggattcatgacgctctgtaccaataattttcaaaccaccggcttctcttgctacatcatccagcttgatatcggtaccacgacctgccatattcgtagcaatagtaaccattccggcttcccctgcatgtgcaacgatttcggcttctttctcatgatattttgcatttaatacctgatgagggattccttccctctttaacattttactgattaattcagaggtctcaatggtaatcgtaccaaccagtaccggctgattttttgcatgtgcttctttaatcgcctcaacaactgcatggaatttttctttcttggtcatgtaaacggcatcgtcatagtcaatacgcgcaaccggacggttggtcgggatctcgataacatccattccatagatttcacggaactctttttcttctgtcaaagctgtaccggtcataccggatttctttgcatatttattaaagaaattctggaaagtgattgttgcaagcgttttactctcacgtcttacttttacatgttcttttgcttcgattgcctgatgcagaccatctgaataacgacgtcccggcataatacgtccggtaaattcatcaacgattaaaacctcatcgtcttttaccacataatcctgatcgcggaacattaaattatgagcacgcagtgcaagaataatattatgctggatttccagattttccgggtctgccaggttttcaatattaaagaatttttctactttatgaacaccctgttctgtcaggtttacgattttatctttttcatttacgataaagtcaccggtctcgatgatttcctcacccatgatagctgtcattttggtcatttcaccactggcttctccgcgctctaactgtcttgcaagaatatcgcacacttcatagagttttgtggattttccactctgtccggaaatgataagaggcgttcttgcctcatcaattaataccgagtcaacctcatcgatgattgcatagtgtaaatccctttgcactaactgttctttatagattaccatattatcacgcaggtaatcgaatcctaattcattattggttacataagtgatatcgcaggcatactgtgcacgtctctcatcatttttcatggaattgagtacaacacctaccgtcagtcctaaaaattcatgaacttttcccatccactctgcatcacgatgtgccagataatcattgactgttacgatgtggacaccttttccctccagtgcatttaagtaagccggaagggtagataccaatgttttaccttcaccggttctcatctctgcgatacgcccctgatgaagaataattccaccgattaactgaacacggtagtgctccatatttaatactcgctttgctgcctcacgtacagttgcaaatgcttccggaagtaaatcatccagtgtttcgccttcttccagacgttttttatactcccttgttttcccacgaagttcttcatcggaaagcgcctgcatagatggacgaagggaatcaatcttatctacaatcggcatgatacgttttaattctcgctggctgtgagtaccaaacattttctcaattatattcatacttaattatactcctgattttattactagcttaaacataagtgtcatactataagcgtatctacactataccacagtactatttattgtatcactttccagtaacgaaaacaagggcaggaattatgaaattcccgccctcgtagctctgatttttaccagttaattactaactgctttgtcatctttcctgttaaagcttcacttctcttatccggaccgtttgttccgacaaagagaacactggaagaagaatcgaaaatcttttctccttcgtcatttacgactttataagcttcttttgaaactgtaatggtcagctctttttcttcccctgcttcaagagaaacttttgcaaatccgcacagagccggatttaccggtgcatacttagaatcctgattcttgatatacacttctactacatctcttgttgctacttcagaatgatttttcacggtaacgcgaatttcagcatcctgctctttttccggtgcttttgcaaattctgccttttccacctgcacatccccatagcttaaaccatatccaaatggatataatggttcttcggtcagataacgataagttctgcccttcatagaataatctgtgaaatctggcagttgatctaaggtacgatagaaggtaatcggcagttttccacttggagaaacttcgccaaataagatatttgccagtgcttttccaccctgtgaacccggataccatgcctgaatgactgcctctgctttttcttctgcctcagaaagattcatggcacttccggtaaagttgcatacaattacttttttaccggtttctaatactgcatgcatcagtctctgctgactctttggaaattcaagattctctttatctccggacgcataagcatttccggtatctccctcttctccctcaagtgattcgtccagaccaatacatagtacaaccacgtcactatgctctgctacgctgagtgcttctgcaattctgtcatcttcctgtgcaagcgcttcttctttatccagaaataaatgacttccttttgcatacatgactcttacatcatcgccgacatagtcctgaattccttcaagtactgtaatataacgggaagctgttccatgataatttccatccagagagcttctgttatctgcatttggtccgataacaccaataatcttaagttcttcttttttgagcggtaagattccattattcttaagaagaacaatgctttcttctgctgcttttctggaaagttccagatgttctttggattctactgctgtatacggaatcttatcaaattcggtctcgtcgaacattccaagcagaaatcttgtagtaaagagacggattgcagcctcttttactttttcttttgtggtcagtcttttatttaatgcttcttttaaacacagataagtacagccacaatttaagtcacagcctttatttaatgccagtgctgaagattctacaccgtttttggttaccatatggtgttcatggaaatcacggactgcccagcagtctgacacataatgaccttcaaacttccagtcttcacgaagaatgtgttccatcagttcttcacttgcacagcacggttctccgtttgtacggttgtaagctcccatcactgcttctacatccgcttcttttacgcaggcttcaaaagctggaagataggtttcatacatatctttcttgtttgcttttgcatcgaaagaatgacgaagtgcttccggtccggagtgaactgcaaaatgttttgcacatcctgctgtctttaaatattctccatcaccctgcagtccttcgataaatggaactgcaagtctggatgttaaagtcgggtcttccccataagtttcatgtcctcttccccatcttgggtcacggaagatatttacatttggagaccataaagtaagccctttgtaaatgtctctatctccatgctttatagactcattatattttgcacgtgcttcttctgaaataacagaagcctctgccttcattaaatctgtatcccacgctgccgccattgcgattgcctgtgggaatacggttgctgtaaccggctcttgctactccgtgaagtccttcattccaccagttatatgcaggaattccaagtctttcaattgccggagcatcaaattttaactgacttgccatctcatctactgtcatctgtgaaaccagtgcttctgcccgttctcttgctttttttctgtctctcatctttttcctcaattcctctctttatttaccagcagactattttattagcagactttaattacaccttttacgatatctgctttattctttacgcaggaatccagtgcattctgaatatcatctaactcaaagtagtctgttacgatatctttgatattgatttttccggaagcaactgcatcgattgccatcggataaatatttctgtaacggaatacagttttaaatgtcagttctttgtcaagtgccataccgattggcagtgtcatttcaccgcttgcactgtatccgacaaatacgatagttgcgcctttatttgcaccttttattaactgggaagctgtaatctgagaacctgcggtttcgattccgaggtcaaatcctcttccacctgtcagttccataatgcgggcaaccgtatcttcttcttttccgttgataactgctgttgctccaagttccaatgctttctgcagacgtttttccataatatcaactacaattacattagatacacccattgctttcaaagaaagcagagttacaaggccgatgcatcctgcacctgtcacaactgctgtctgtccaagatgagcgcctccctgatttgcggcatgcataccaactgctaatggttcaattaatgcaccttccattgtacttacgttttccggaagtttgaaacaaaggtcagcttcatgtgcaacatactcctggaatacaccatctaccggcggagttgcgaagaatacaacgtctttacacagattgtatttaccctgtttgcagaattcgcattttccacaggtttttcctggctctaaggcaactctgtcaccaacttttaagtgttttacattttcgccaacttccacaacagtaccacctgcttcatgtcccagtacgaaaggagtttctacgataaaatctccgattcttcctgattcatagtaatgtaagtcagaaccacagattcctacatattctacttttacaagtacttcatcactcttcggtgtcggaacttcacgttcctgaatttctactttctgtaaatctgtcattactgctgtcttcattttcattttaactgccattgtcttgttcctcactttctttttttatttttctattgataatgttactctgctacattctttttccccgagataagaagtgtctctttccatgtcttttggataaacaaccaatctctccaatacaagtcccgcttctcttgcggaaactgtaattttattcaaaccttttttcaaagcaatctctgtacttcctgcatgttcctgattcaaaactgcctgttcccatggaatgcagcccggttctccacctttatagccatcctctgtaaatgtaaccagcttatccacctcgccatttacagaaactcccatagaaagttttcctccataaatcagtggatttgcaggagaagtataaagttttaagatgcactctttttcttcttcactaaagagttcatacgttacagacggagcattttcttttgaatcaaacgccgccgttaccggaaatgccttaattccgctttgatatttcccaaagtcgtataactctttaaattctacagtttctttctcatatgttcctgcatttttatctgcataatgaattgcatcgattacaaacatgccatgttctgcaagaaatgcacctttcggaagtgcactggtatcttttttcagtgcttttaccagaaccggaacaaactcagtttccgtcttaatttcaaaactgcaggatacttcttctccaagcggaaggttttcttcttttaaagaaatttcaacttcgtcctgaagtgcagtctctccggacattttggaaaattccagccattcgcatgaagtttcatcctgagattcatgtgcaattccatccaatccgacttttcttgcgccttcctgtatcttccattttacgcttccctgaccaccgttagcaatttgaattttagcctttttgctagaagaaactacgaaatcatcaatcacaagtgtaatcgggaaatactggttcgtataatgctgggttttatctgctcttgtcacgaccagcctcggttttttcggaagacgaattacgtgacgcaccggatatctccagtcttcatcattccagtttgtaaatccaatatgagaagccaattccattcctgcccattttccatctttaaatgctgccatctgagcttttaaggcttcatctttttcaatacaagcttccactaacttgtcatactcatttgcaactgcctttccctgagaagcatataagtggttttttccagaataaagatgcattttcagtaaattaaaggatgcttctgctgagaaataaatcatgctgaagtaagcatctcccataccacgctcctctaaagttttccacagcctttcattcttttcttcgagttttccacaaaaagataactgtttttcacattctaagtaatgtgccggatggtaaaccgtatcatttaaagattccggttttcttaatgcattgatttttaaatagccttctaatacttcctgaatttcttctcgctcttcttttgaagtatagcttccgaacatggatgaaatccatgctttggtatactcttttgtgctgtttggagcagaagaaccccatttttcaaaatcatatgccaaatccataaagtaatttaacggaaattcctggaatttcacatctccgacattgacaatccagagttctcttactccgtattcataagcttctgtcatctgctcccaaatcttggaaagttcggtagaagaaacccattcataagaaacagggtctccatgataatccagatggaaatacattccaaatccacctttatgatttctctcaaatgcttccggaagtgctctcatatttccccagttgtcttcgcaaagcagtaaggttacgtcctcaagttcttcaaatccacgcagtccttcttcgcttccaccaccaaaatagtaatcttctacttctttataaactgcaaataactgcggaactttctttccgtctgtttccagatgttcatgaatcatctcacgctgttttgtaataatttcttttaacagacgtacattatcggaaatcagagaatcttcgcccagcatcttgctgtcgttttctcctctcattccgactgttggaaatacattgtgaccgatgcttcgtttcacaccgtcctcccagaatcttaagattccttctttgtttgtcacatagctccatgcatctccatacggacttttcggtcctctcaccttgctgtattctgcaccggaacgcatacaaggttcatgatgagacattccgatataaattccgtattcatcagccagtttcatagactccaaatccggaccgtctaacataaagttttccgcccacatcgccggccataaataatttcctttcatacggaggaggtattcaaaaatatggtcatacatttttgcattaaaacttccaaaatgagaagttgcccagtttccacaacatggccattcatcattgatgaaaaatcctctgtatttcacagacggctcttttgatacaaaagaatcctcttcttttaagataaaagagtcctgtttcacgtactggcagtctccccagtcaaccattgctgtcacacctaacaactctgacagatgaaacagtccataaatggttccaagtttatcacttccgtaaataacaagtgcgctttcaattccttctaccggattttctgccacaataaacgcataagattcccgttttccttctacctgtccaagttttgaaatcttactgcacagtgtttctgccagttttccgcttcctgcagtcactgcaatcactgcctgttttgccggtacagctgtttcacagatttcaggacaaaatgagagtgtcccctctacatcttttgccactttgcctgctacttttttcacaccgattccacattcttctggaattacaaaataaagtcccttattctttgaaatttctaatgtagccatacatcctccaggtttatttccatgttttttgttctaaaaagaacccgacagcttgcgctgccagattcttttctctggttactgcttattttaattatttaagaaggtcttttgtatcctgataaatttcgtttgcttcgtctacgtatttctggctgcctttgttttcacagtcttttacgtaagcatcccagtctttatccagatcacgtttaccagtgatgaattccagagctgctgtatttacatagtccataagaggagtcttaactaagttcatttcttctttctgcatttcatcagcaagaattggtggttttaattggatatcttctttgcttgcatttactctttcgttccattctttttctccatcagagaatttagaatactgaagttctttagaaccgccgtaagcaaatacaccattaccaaatccatagtctacgtttaactgtttttctgcacctgggttaataccattgtagtagatgtcagagtttaatacgatatttccatcatcatcttttgtataggtttcaccttcaacaccccacagacataaagtctgtccttcgtctgagtaccataaccagtcgatgaaacgaagcattttgataaatccttcttcaccaagttcatctaaagcattctgagtaatcataataccattttcaagacgaccagctgcgctggaaacttttaactgtcctgcggaacctgccggaggagtcaggaagtataattcagctccatcgacctgcattttaccattctggatatcagaataaatctgatagttcatatttaaaacataagaatcaccacggaagaattttgcctgcgcctgcgtggtatcctgtgtaaatgtttcagggtcaattaaaccatcttcgtacattttgtggaacattgtgaggtattctttgtattcgtctgttgtatcagcgaagtagaattctcctttatcaaagtcaaattttgtaccatcttttaagccccagtcaccaccgtcattggagtaaccacctgttacattataaactgttgcagcgatattcatggtacttccgaacccaaatccatcagaccatacataatctgcttttgtatattcttttactttctttaatgcttcataaaagtcatcccatgtccaggagctttcatttgaaaggtctacacctgctgcttcaaatacatctttacgaattgcaagagagtaaccaccggctgttgtctcccacatacccggcagacgatagtatttaccgttggatgccagaatctgctgtaagtcgtcttccatgccccagtcttttacgcatttttgatagttcggcatgtactgaacccagtcactgattggaacaatctgaccgctgtcttcgtaagcagtagaatcataagttttcggaataatgtaaggagcactaccactgtttacagaagcagaaactttatcattgtagtctgttcttgcaacgattgtcaggtcaaatgttacatttgttttttcttcgattgctttccaaagtaaccagtcctcattgtaaggatagttttcatggtcagagtacatcatggaatattttactgcttcgtctgaatggaaagtttcgtcttctccataagtgtaatcaaggtctttgtctgcatcttctgctgaaagagtcggtccgtctttgctgtctgatgatttgctgccgccacagcctgctaatgtagtgccagccatagctaacacaagtgtcattgctacgagtttctttttcataattacctccttaagttatgattttttaacgtacgtttaatcatacgcaattcacatagttaaattataaatttccttatatgcgggtacgccttggcgtaccctgttaaaacttgttaagtatcagccttttactgctccgattgtcataccctgtacaaagtatttctgtacgaatggataaacacagataatcgggatagatgttaataccatggttgcagattttacagttgcctgtacactacttgcatcggaagaaccgatttccgtattatttgccccctctactaactgtcttacatacagagcaaccggccatttgtcttttgaatctaagtacagcattggcgtgaaccattcattccacatggttaccatatagaacagacacatggttgcaatgattggtttggataacggaataatgatttttaagaaaatctgataagtattcattccgtcgattgctgctgcttcttcaagttcttccggaagtcctgcgaagaaagatttcataaccagtaagttgaatgtactgattgcatttggaagaatgattgaccacatactgtcctgaagacctaaccactgtgtgattacgatatagtttggaatcataccacctgcaaaatacatggtgaatacaactaacggtgtaattactttgtttaatcttaatcttggctttgacagcggatatgcaatcagcgctgtacatgctacagagataaaagttccgactactgtataaaaaatggtatttccatagtaacggaagaactgattatctcttaagatatatttgtaagtgtttacgttaaatccgattggataaaaagtaacttttccggcacttgcagcagcatcactgctgaatgactgtgctacaagatatacaaaaggatacagggtaataaagatgacaaaaatcataataatcgtattgattacctgaaaggcacgatatccttttgttggtttcatattgttcattttcttcctgtactcctttctaccataatgatgtttctgtaaatttcttagataagaagttcgcagatgtaacaagaatcagaccaattacaccttcaaacagaccaactgctgcggcgtaactgaagttaccacctgtaatacccattctgtataccaaagttccgatgatgtcggctctctgctgattcagtgggttgtataataacaagattttctgcatattacttgatgttacgataccaccgatatccatgattaacagggtcatgattgttggcatgattcccggaattgttacatgaataacctgctggaatcttcctgcaccatccatagatgctgcttcatataattcagtgttaatacctgtcattgctgccagataaaggattgtaccccatcctaatgcctgccatacaccagatgcgatgtatacaaaatcgaaccaacctggttcagacataaatgcgattttatcagctccaaacatctcaatcaatttgttgattggtccttgtgctgctaacaattcttttaccataccacagacaactaccagtgagataaagtgtggcagataagaaattgtctgcacggatttcttccacattttctttctgatttcattcagaagaagtgcaaagattaaagtaaccgggaaacgcactaataaatatccgatacttaatctcagtgtgttccaaaatgcctgccagaactgagggtctttgataaactgttcaaagtaccgaaatcctacccaatattcaccaaggatattcggacctcccttatagcgtctgaaagcaatgatatttccgactaccggtacatacttgaaaataatgtaatataaaagagggataatcattaaagaatataatctccactcttttttaatatgtctcagcagtgaatgttcttttgtattaactgctatctgacccgactgcggaacctgtacattgtctttctgttttttcatttcattgctcctccctttcaactaaactttcttgtgttccacttgataaaccaattatatcgtacggttagcgcttatgcatttctttttttgccattattttagcaacatgtgcataatacttgtatgtttttatgcattttcccatttggctagtcacatattgctaaaaaatgcccaatttttgctatttcttctggctattttctatatctttcctcataaattgctcacatcttgcgaattaacaccttaataaaaacaaggactgcctgtttttcccatgcagtccctatcttattttttatgcttcgcaaaaacagatactcgtaaagttaaagttgcttcccggaaggaataccagacttacatcgttaactccgtaaatcggttctatctcaaagctctgtttcgtctttgttcccataaattcaaccattctctgttcttcaactccatctttggcaaatttcagaataatcgtattcttttcaagcggagtacttccacaaattacaagactctttgttcctttttcgccaaaatccatctgctcaaaacgaatggtaacgttatttccaatctgatgaatttcttctcctgcacgttcaaagctgtctccgtaaatcttgtcacattctcctgccacaagtatctgccatgcacgattatagcgtttaaaccagaatcctttgatatgaaccttcgcacgaagtacaaagcagatttcgctgattccacgcaatctcttattcaaatggaaagtttctaactgataaacattccacatttttggcttttgataaataaatttgccaagcagactgcctccttcatccggcatgccttcataaatttcgatttcataagggtcatcggtcagtgcaaaaaccggaacggtaatttcgtcagaaccatacacgccaaagtcaatatttctaaatccaacctgactttctccatctcttgcagtcgccactccatgttcattcccgtttccgatttcacctttgctgtagttatataaaccggcacttacaaattcataagggtcggtaaaggcttttccaagtcctgtaataataaattccagggaagaaataatacagatatggtctgttccgctctttgacatacagcgaagtctgaaattcccatcactctttgcggttacttttacgcgaccgtccccgatttcttcagttgttgcaatctttaacggaatccccgcatcatctacaatactccagattaattctttatcttttgcatttgccggactaaaatgtgcttttacgatcgtttcctgattttcttcatgcagatgcagaccattttcgctttccagataaatgtttctcacttccacatcctctgttttttccggttctgcttttcttactccttcataagcaagcagactgattccttctcttacttttgcttcttttaccggaatgaccagttcttttgttttcattcctgcactgctgacacggatttttaaatctcctgctttgtcttttgtcttaaatactgctaagagttttccgctgaataaccttcgacttccggaagtatactgctcggtatcggtactgtctccattatctgttccaactaaaactccggcgccttccgcttcaatccagacacggttgtttgcattttgaaccggatatccgtctttatctctcattgaaatttctacaaataataaatcttcaccgtctgcaagcagttcactttcggatgcgtttaagcagattttttccgcatctttaaacgaatgttgaacatcttctgcgatttcatttccttcttcgtcacaggcaaccgcacgcagttcgccctcttcataaggaatctgccagtgtccggcaagctgttttccactctttgcatctaatgtacagattccctgactcttgccattaaaaatcaattccacaaccggcgcattggagcagactcttacatcaataaactgtccgtcattaaaatcccagtatgggaaaatatgcacaaatggttcttttctataatcgacccatcccgccttatataaatagaaagaatccttaaaaaatccagctgtatcaatctgtccaaaataagaattttttgtgtgatacggagtcggctctccgatatagtcaaatccggtccaaataaactgtccacaggaatacggatgttctgcttctgcctgaatacatgcttcaaccgattttgcaccccagcttgttgtggaatttccaagagcagaacactgctcatcttcatctgtcagtacagactggcggtatgggaaatgatagattccacggctctgtacaatcgaagcagtctcacttccataaatgacccattccggatgatttttatggtggtctgcataatatttctctccatagttatatccggcattttttacgatatccgcacatttctgtgcattttcccacggcatatagttcgaaccaatcgtcacttcggcattgtttctcgggtcgtattttcgtacttcttctattaaaatacgagtccagtactgtcccttatcaccgacatgggtatcataaatttcgtttccgatactccacatcatcagacttggatgatttctgtcacgtttcacccagtttttgacatctctttcataccattcagggaaaaatcttgcataatcatacggattcttagaagattcccacatatcaaaagcttctgtcacaatcaaaagtcccatctcatctgccagttccatgacttccggtgccggcatattgtgagaaagacggactgcattggttcccatctcttttaagagttcaaattttcttctcattgcctttttatgaaaagcagttccaagacatcccaggtcatgatggtcacagacaccgtttaattttacttttcttccatttaataaaaatccctgatttggattcaattcaattgtacggaaaccgacattctgcacttcctgctcaattaattctgttcccttatataaagaaacgattaaatcataataatccggatgttctacatcccagatatccgggtggttcacttttgcctttaaataatgcacataaataccgtcttcttttgttatggtctcttccccggcaagtttctgaatcgtttctgaattttttgcttttaattcataaactacctgcagttcgcttgttgcttcaacctcggcatcaatctctacctgccatacattttcctcttcttttttggctgaaaaataaattccatctgatacaaaatgttccaaaggaagcctctttaaccatacattacgataaattccggctccggtataccaacggctgtttggagtctgaaaagtaatcgatacaaagatttcattctcgccgtcttttaacaggttcgtaacgtctacttcaaatgtcgtgtatccatatttccattctcccgcctgtactccatttacatagatacggctgtccatgtaaattccatcaaaccgaagtacgaccagttcttcttcctcttttgtccagttgaatttcttgtgataccagcccattccgtcttcgtataaattttccacctgggaaatcatccagtcatgcgggattcctactgcataaaaatcctgcatttttttctgtacctgttctaagcttgtctcaaggggctgtttacaaaactcccatccatcattaaataatcgtttcatctgccgctcctgttcctttacttttttctatccgatttaatcttaattctctactttatttctatctcaaacggagctgtcaaaagtccttctttattttttaacagaccatcaagtggggaatccttccatgcataacgcacttttttaatttcttctccaaatacttttactttcgtatcttcaatttccgcttttgccggataaaatactccatctgcttttgcagtttcaaattcatttacgctgtctccacagacaatttccagtggctgtccatcctgtgtatcaaaaataaattctacgccatctgctgttttttcataagaaatcagctttggtccttcactgataatctcttctttgtacatcacttttcttgctgcaagataagcacggtgtgccacaccttttttattaagcggatgcaaatcattgtattctcccaaatctaagtttacagtaactgccacatccggaagttctgctgcatttttctgggcttcacgaatgactgcccatgcgccgtctccacggttatccattccacaagccggaagctgaatcacaataaacggcagttcttcctgtttccaatgtgctctccagttcaaaatcatcttctgaatcaaatcttcataactttccggataccactcattggattctccctgataccacagcactccttttacggtcatgttggtacacggtgcaaccattccctgatacattccggttggctgtcttgtaataaaggtaagtatcggagcctgttcgctgactacacgcacctgatagtcccatgttccacgaaggctgattttttctcctgattcaaaacatacatcacaaggtttatccggagtgatacgaccttttccgtcacgacactccagacggataaagatttcattttctcctgcctttaaaagtccctccggtaccggataaattcttggcggaaaacaataaccggtttctcccaccttttctccgttgataaagatacggtcactatccacaagcgttcccatttttaaaattgcagattttcctgccagttcttttggcacttcaaaagttctctttaaatgtagtaatccactgaagttttcaagtccctgtttatcaaaccagcccggaacttccaagatgttccacggtgcatcctctgtctctgcctctttctttgaaagcagttcatgccatgcattttcttttttatcctgtgcactgagcagattttcaatatatccgtcttgtgcaaaacgctcttttacttctaaaaactccgggtaatctgccaaggcttcttcactcatccatgcttctaccggagttccccctttgctgatgttgataattccgaccggaacctgctcttttttctgaatcatatctccaacgaaatatcccagtgcagttgtctcttctagtggcattcccacacattcattccagcctgcttctttatgttcttttaatgcccctgtaaacaccggacattcttccactttatactggtgtaccattgcatttcccggttcatccggaaacatttcacgcactcttgtaatcggaagttccatgttagactgtccagagcagacaaatacatctcccacataaacctcttttacgactgtctcctgtccatcttcactttttatgctcaacacataaggaccacctgttttttcacaggaaatttctgtctcaaatgttccttccgcatcacatttggttctgtaaactttctcctgaaatgtaacctcaagctctgcctgtggtttgtaccatccccaaattcttgttttttctccacgctgtaatacacagccttcctgcagaagttttggaagtttaattgactgactcataacggtctccttttttctactctattctgaatttactcgtttctttattttacccttatcataaaggattccctgtaaaaattctcccttaatgttgccgagtgtttcccgattcttgctttctttttatacaacaaaaataagaaccccgaaaatgggattcttattttttcctgcacatctcatcggtactgctttttccacgatactccgatggtgaacatccttttattgatttaaaggtacggttaaatgcactaatcgaagaaaatccggagctcattgcgatttccgtcacactttctccggtcgtactaagcaattcctctgcctttgaaatccgcttctgattcagatattcatagaatgtcatattcatacactgcttaaaaatccttgtaaaatggaacttggaaaatccactgaattctgccacctcttccaaagaaagagcttcctgatagtgctgattaatataattacaggcactcataatcgtttccatatattcctttttcttttccggattattttctgtgcgcaaaacctgatttttattctttcgacctccgcttataacatttcgtccgatatgtacaaatatttcaattaattttgcgtaaatgactgcattaaaaaatgccttttcctcatcatactccacaataatggaatccatctgacgttttacaaaactgtataatctctgcgtgtcttcttcctctgataaatacagcacaggcggaagcacatttaacagtgtctccatttcttttaacgaatataataagtagtcactgaattgtaaaataatacgttccccagttggcggtgcttccaatccatgcagtacacccgggttgataattaaaatatctccttcttttaaacaatactttttacttccgataatcacgttatatccttcatgaatcggcataatgatttcaattgcagtatgccagtgctccgggtaatcctcgtagtctacattatgaaacaatctaagtcctaatggattaccatagttgattgtctcgtgtgttccctctaagatttctatcatccttcgtatccaccatccctatctcatctttatagattttgttatcaggttctctataactagtatactagcatggtagttttggaaattcaaggtacttttttcattttgcacgcaaaaatagagactgtagaacttctccacagcctctatccatagcctattcaatttttaatctttcattcttaatcttcatcagagaaatccggttcaatcagaccatacgtgtttccttttctcttatacacaacattaacctcttctgtctctgcatttaagaatacaaagaaattgtgtccaagtaattccatctgtacgcatgcatcttccggatacattggtttaaatccaaattttttggtacgaatgattttaatttcacttgtatcatcttcgtagtctttttcaataaattccggctggaatgtttccacgttctgtttcttgttaataatttttgttttgtattttcttaactgtctttcaatgatttcttctaccaggtcaatggaaacatacatatcattgcttacctgctcagaacgaatgatattaccttttactggaatcgttacttcaattttctgacgttctttttctacacttaatgttacaataatttctgtatccgctgtaaaatatcgttccagttttcctaacttatcttcgactgctgttctaagtccgtccgtaatatcaatgtttcttccgcttataataaatttcatgctgtccaacccctttaacgtgtattttacaggtgttttactttcgttcctgtaatgtaaatctattatatcaatattcagtcaattattcaacagtttttagaaaattttaactattttatcttttttgtatacatcattattatgtaaacacagttgcagtctgattgcagctgtgttaaatcttctttattgattatttttattgttattcaaattattgttatcattattattgttgttcccgtcttctgtcaaatcattgatgccgtcttttaatccttcaccgatatcttccacgccatcaccgatgtcttctccaatatctccgatgacaccgtccccattattattcctattattatcattcctatcattattcatagtatcatcattcgtcgtaccattatcatttgtcgtactatcatttactgtatcattttgatttccgcctgtcgcatcattcatgttatttccacatgcggtcataacaaccatcattcctgcaagcagtaaagtaaatacatattttttcatcgatttcttctccttttcctgttgaaaataattttcctgcttataatatgcgacaaaaaccggatttttatgttttccggcaacaaaaaaatgccaggaaaaatttcccagcattttttatatcaatacgctttttattttcagctaaattttctattctatcagccgataacatcgctcatgtcatacattccagcaccttttcctttgaggaattttgctgcttctactgcaccttttccaaatacagcttttgagtatgcagtatgcttgaactcaatcacttcgtccggaccacagaataacacttcgtgttctcctacgattgttccaccacggactgcggaaattccgagttcttttttgtctcgtttctgtcttacctgacttctgtcatagatgtattcgtactgattgtccattgcctcattgatactgtcagccagtgcaagtgctgtaccgcttggtgcatccaatttctgattgtgatgtttttctacgatttctacatcaaatcctgctgctgcaagcacttttgaagcatcctgcagtaattttaaaagcgtgttgattccgagggacatatttgcagaacgaagtactgctgtttcttttgcagcttctttagtctttgcaagctgttcttcagaaagtcctgttgtacacagtactaatggaagtttctttttcgcacaatactccaataccttatctgtcgcttttgcagatgaaaaatcaatcattgcatcggcctctacatcacatgtatcaatatctgtaaacaccggatatccattgtctctgttatctacaatatcaattcctgctacgatttctgcatctgcatctttttcaaccagaccactgattacctgtcccatgtgaccgttacagccactcataataattcttaccatctttcgttcctctttttcctgtattctcatgctactacagcaaatattaagtaatccacttattgttttgccttaattttcgctgtattacttgataatttcgagtgataccactcggtctgctgcttcttttaatttcggagttacaacatttcctgtcaaaatcatttccatctcctcatcttttgcctgtatcaggttgacgacatcatcatctgaaatgattccaaactccacagcacctaatacttcatcaagaatcagcatgtcacattcctgtgtcacaagaacttttttcgcataattcaatccgttacggatattgaagttctcttcctgacgctcttcttcggtcagatcctcataacacttgttctttttttcaaatcggaacaattttacattcggttcaagaaccgaaagataatccacctcggaagtcgctctgcctttcaaaaactggattacaatcgccgttttaccatgaccgattgctcgaattgcctgcccaattgccacacttgttttgccttttcccgggccacaatacacctggacaattcctttgttttccatatttacacctcttacagattcgatatagacctttttcctctgtttcttgcgttttccacatgctgtgtatatcttactacacctgaccaaagattgcaatccaaattcctgtccggcaaaacttctctgtttttattcattcagcaggtctgtatctccataattttctccgtactccaatttactgacagaaacttcatacgcagttcgcttttctgtctcggtttcacttaatttctttatatattccctgctctggattcttccccagatatggagacgtcctccaacttcaaatgaacgggcaaaatttgcatttcttccccaacagatacagggaatataatccgattttccataaggacggttcactgccagaagcacatccgcaatctctcttccaagcggagtcattctgtgaaccggcggcttacatatgtaaccgttcaattcaatcagattcgtctctactgaatcatcttcttcctctacaaaggtaagttctctaacaaataccgacaacaccagccggttcttcttttcttcatgtctgttataggaccgaaactgtccctgcacctgtatatattcacctaagtaactttgcgtaacatccaccagtctttctgagaccataagcggaattctgtcctccgaaccacttaagcgtttcaccaaaatgtctaccatgtaaaagccctccccatatacttcgtggctctttacaaactctgatgcaactacgcccaccattgatacctgattgttttcaataattttatctgccatgaatcactttccccttcctctttttggtattttatctttattaatctattcatgagagtggggatttattcctgtttttttatttttttttgaaaaaatttttgaaaactaaattttttctttgtatttacggctaattgtgatagaatggcttgtgattaaaaatgttttttacggtttctaatgtgccatttactattttatataggtacattctatttggaaaagaggttattatgaaaacaaaaagagaagatatcagaaatgtagcaattattgcccacgttgaccacggtaaaaccacccttgttgaccagctcttaaaacagagtggtgtattccgtgaaaaccaggaagtgcaggaacgtgtcatggactccaatgacatcgaaagagaacgtggaatcacaattctttctaaaaatactgctgtttactacaaagatacaaaaattaatattatcgataccccaggacatgcagatttcggtggcgaagtagagcgagttttaaaaatggtagacggtgttatcctgttagttgacgcctttgaaggtgcaatgcctcagacaaagttcgttttgaaaaaagcccttgaactggatttacatgttattgtctgtatcaacaaaatcgaccgtccggaagcaagaccaaacgaagttatcgatgaagtcttagaacttttaatggacttagatgcatcagacgaacagcttgactgtccatttttatatgcatctgcaaaagcaggacacgctgtacttgaccttgctgacactcctgaaaatatggaaccactctttgaaactatcttaaaatatattccggctccggaaggtgaccctgaagaaggaactcaggtactgattagtaccatcgattacaacgaatatgtcggacgtatcggtgtcggaaaagtagaaaacggaacaatccgtgtcaatcaggacgttttacttttaaaccatcatgatcctgataagaaaaaacgcgtaaaaatcagcaaactttacgaatttgacggacttggcaaaaaagaagtaacagaagccagctttggttctattgttgcaatctccggtattgcagacattcacattggtgataccttatgttctccggaaaatccggtggcaattccattccagaagatttccgagccgacaatttccatgaacttcattgtaaatgacagcccgcttgccggacaggaaggcaaattcgtcacttcccgtcatttaaaagaacgtctcttaagagaattaaatacagacgtcagcttacgtgtagaagaaacagaaagcacagactgctttaaagtttccggacgtggagaacttcatctgtctgttttaatcgaaaacatgcgtcgtgaaggctatgaatttgcagtcagcaaagcagaagttatctatcacgaagatgaacgcggtaaaaaactcgaaccaatcgaaatcgcatacattgatgttccggaagaattttccggtactgttatcaaccgtttaaatgaaagaaaaggtgaactgcagggcatgagtccggcaagtgacggaaccgtccgtctggaatatcacattccatcccgcggattaatcggtttccgtggagaatttatgacctccacaaagggtaccggtatcatcaatactgcttttgacggctatgcaccatacaaaggtgatatgaactacagaaaacagggttcattaatcgcttttgaatccggtgaagctgttacttacggactcttctccgcacaggatcgtggtactttatttatcggacctggtgaaaaagtatacagcggaatggttatcggacagagtggaaaatcagaggatattgagttaaatgtctgcaagaccaaacatctgaccaacacccgttcttcttctgccgatgatgccttaaaactgactccgccgagagtgttaagtcttgaacaggctctcgaattcattgataccgatgagctgcttgaagtcactccgaaatccctgcgtatccgtaaaaaaattctggattccagacttcgtaaacgtgacaacatgaaaaaatagtaaaatcggagcattaaatatcgaataaaactcccaaaaaagagaacatttccaaccggtaatgttctcttttttttacttttttgatacaggtcaagcggatattcgcaatccgcttcgctacttgctcataaccaaatagctgctacgcagcttatcagaaggggcttgccccctcctgatacaagcaagtccccacccctgcttattgctttttgcaattgaagcaggggacttccttgatttggttaaatttttaacatttttcagaaaatttcgattattttttaacaattcttgcaatcacttcgttactatgctaaaataatttcataaacaaatggtttttatatgcaaagcaaccaattttattttaggaggtctctgaatggcaaaaaaagtcgaatccaaagtacctgaaactatcgatagcgtagaagcactccagacaaagattgctgctatgagagaggcgcagaagaaatttgccacgtttactcaggagcaggttgataaaatcttttttgaggctgcaatggctgcaaacaaacaacgtatcccgctttccaaactggccgtggaagaaactggaatgggtgtcgttgaagacaaagtaattaagaaccattatgctgcggaatatatgtataacgcttacaaacgtgtaaaaacctgcggtgtgattgaagaagacaaatcttatggaatcaagaaaatcgctgaaccggttggtcttgtaggtgcagttattcctaccacaaacccgacttctaccgctatcttcaaatgtctgatttgtttaaaaaccagaaatgcaatcttaatcagcccgcatccgcgtgcaaaaaaatgtaccgctgaagctgcccgtatcgttttagaagcagctgtaaaagcaggtgctccggaaggaatcatcggatgtatcgaagagccgaccatcgaactttccaatgaattgatgaaagctgccgatgtcatccttgcaaccggtggtcctggaatggtaaaagccgcttattcatccggaaaaccggcaatcggtgtaggtcctggaaatactcctgttatcatggacagctcctgtgatattcctaccgctgtttactctgtcatccattccaaaacatttgataatggtatgatttgtgcttctgaacagtccgttactgcaatcgctgatatctatgatgcagtgaaaaaagaatttgtcaaacgtggatgtcatgtactgaacaaaacagaacttgaccaggttcgaggcattctcttaacagaagcaggcactgtaaatccgaaaattgtaggacagccggcatacaagattgctgctatggcaggtgttactgttcctgctgatacaaaaatcttaatcggcgaggttacatccgttgatgtttccgaaccatttgctcatgaaaaactgtcccctgtccttgctctttataaagcaaaagatttcgatactgcacttgatatgtcagaacagcttatcgcagacggtggatacggtcatacttcttctctgtatgtacatccatcagaaactgaaaaacttgccaaacatgccgctcgtatgaaaacatgccgtattctggtaaatactccgtcatcccacggtggtatcggtgacctttataactttaagcttgctccatccttaacattaggctgtggttcttatggtggcaactctgtttcagaaaacgtaggtgtcaaacatctgctcaatgttaaaacagttgccgaaaggagagagaacatgctgtggttccgtgcacctgaaaaagtttactttaagaaaggctgtctgccggtagctcttgatgaattaaagaattattatcataaaacaaaagcatttatcgtaactgatactttcttatatcagaacggtcataccagaccaatcaccgataaactcgatgaaatgggtattccttatgactgcttcttcgaagttactccggatccgactttgcagtgtgcacagagaggtttagagcagttgaaagcatttggtcctgacgttatcatcgctctcggtggtggttccgctatggactgtgcaaaaattatgtggatgatgtacgaacatccggaatgtgcatttgaagaccttgctatggacttcatggatatccgtaagagagtttacaccttcccgaagatgggtgaaaaagcaatgatggtttccatcccgacttcctccggaacaggttctgaagtaactccatttgctatcatcacagatgctacaacaggaacaaaatggccaatcgcagactatgaactgcttccagatatggcaattattgacgctgatttcatgatgagccagccaaaaggactgaccagtgcttccggtatcgatgctctgactcatgcgctcgaagcttacgtttccattatggcaactgacttcacagacggtatggcattaaaggcagctaagattatctttgattatctgccatctgcttacgataaaggagcagctgacccaattgcccgagaaaagatgggtaatgcatctaccttagccggtatggcatttgccaatgcattcctcggtgtctgccactccatggctcacaaactcggtgcttatcatcacctgccacacggtatcgcaaacgctctgttaatcgagcttgttatgcgctacaatgcagacccggcaccggttaaaatgggaaccttctcccagtatccatatccacacgcaaaagaacgctactgtgaagttgcacgttttgtaggtgtgaccggaaagaatgacgatgaagtatttgaaaacttcatcaaagcaatcgctgaattaaaagaaaaagttggaatcaagagaaccattaaagattacggtatcgaagaatctgctttcctcgctacattagacgaaatggttgaaaatgcgttcaacgaccagtgtactggcgcaaacccaagatatccacttatgtctgaaatcaaagatatgtacttaaaagcttactatggtgaataattgaatcattgttaccgcttattcacttttcgttaaatttgaattactcctttcgcgctattacctaaatagcaaaacgaccgctcacagggaaacctgtgggcggttgttttttcttgtcataataaataattgttttgattttttctttactcgacctgctgttcgccttctccgaagtaataataagcattaccactctgaagggtttttccttttgcttctgccagttcactgacagtcacaagtttaaatccttttgcaatcaaatccggtatcattcggattgccgcttttaccgaccattcatgaatgtcatgcatcaatacaacggaaccgtcctgtgcattatccataacaacctgataagtctgatcctcactcttggttgcccagtctctagtatcaatactccagataatcagcggatgatcaattgctgctttgacagaatcgttgaaagaaccacctggcggacgcattacggttgcctcaaatccagttgcagcttttaatgctgcatccgtattgcttacctgctgtgctgctgcatctgctccaattgtcaccaaatccggatgactgtaagaatgatttccaagttccattccagcatccgataattcctttgcaatttccggatatgcttctacattttgtcccagcatgaagaaggttgcttttgcattattttctaccagacaattaagcaattcttcggtatactcacccggaccatcatcaaaagtcaatgcaatcattggacgctgttttgtctcatcgtattttccatcttcatcaaaatagcagtctttgtcatcaattgtctgccatcctgtcaggatataaccatttgaattaaaataatatgtactgccatttacttcctgccagccatcctgataataactgccatcccgattctgataccaccagccgttttcatcctgatgccatccaatacttggcgctgcctttaacttatctacatcagaagcactcatgaccggctgttttcctgcctcaccggtgtcttctgctgcctgaacttctacggtactgctgtttgcattcttagcactactgttttttatatgaacaccggagaacagctttccaactcctcttcctgcaaaaaccaatacgaataccagtacaactgccattgcaccaatccgcatcatttttcttcgacgtaactgacgtatcttttcctgcttacggcgcatcattctctcatgtcgaatacgctgacgctctagttcgtctctttgttcttcgtccatttttctttatccctcatttccttttcacactcaaatcctttgttaatcataccttttttttcgacattatgcaacctctacactcttaattttcctttacaaaagtgttacaaatgaaaaaagagattagccattttctgactaacctctttctactgttttttcaagcagacattctttgacagttcgaactaattcattcatttatttattttctaatttgcctgtacttctgcgctttttactttcgctttctgttttccaaaaaacgcttttgtctctgcaaatacaaccggacttaacgcaatcagtgcaattaagtttggaaatgccatcaatgcattaaagatatctgcgatattccatactgcttctactgtcatgtaaggtccgataaaaattgcaagaatatataaccagcggtatccttttactacttttttattacggttgaataagtattcaatacatctttcaccatagtaattccatccaagaattgtggtaaatgcaaagaataccaaacataccatcaatactaaagatgcaacagccggagggaacgggagtcctttctggaatgcagctgttgtaattgccacaccttcaagaccagtattccatgtacctgttataacaatggtcagacctgtcatcgtacagattacaatagtatcaataaatgtacctgtcatagaaaccagaccctgacgtacggtagaatgggtctgtgctgctgccgctgcaatcggggcactaccaagacctgcttcatttgagaagataccacgtgcaatacccttctgcattgcaactaccatcgttcctgccgctccacctgccagtgcgcttcctgtaaatgcactctttacgattgtgacaattgctgccggaagtgctgtaatatgtgtaataatgacaataaaagcaaatacgaaatagatgattgccataaatggcacaacaacctgtgaaacacttgcaattctctttaatccaccgataacaaccagcccaacacatactgtcagagccagacctgcaatgattgttgcgatagagtaatctctgccaaataatgcgatagtgtttactttatccgggtcaaagaaattacagactgctgaggaaattccgtttacctgtgtgaatgtaccgattcccagtaaacctacacccgcaccaaagaatgcaaacatttttgcaagccatttccattttacacccataccattttcgatatagtagaatggtccgccaagtacatgaccttctttatcgatagtacgatatttgattgccagcacaccttcggaatatttggttgccattccaaaaaatgctgcaacaaccatccagaataatgatcccggaccacctgctgcaagtgcggttgcaacaccgacgatatttccggtaccgattgttgctgacattgcagtacaaagtgcaccaaaactgctgacttcaccttttccgccctcttcattttttaccataaatttcagggctttgcccaggtgccggatttgaagaaatcccatgctgacagataaataaatacctgtacataagatgagaataatcagcggtaatccccataccgctccgtcaatccagctgattacattgttcattgtttcaaacatttcttttacgtcctctctttcttttcgatgcaccactttggtacatttcctagaacctctcttgaatttttcagttcagaaaacaaaaaaactgtggaatcctcattccacagtctcataagagtacgacaaaacatatacaagataacctctgtatactctgtccttttgcctgagagattaacaacataaatgttgccgtacaccttcggcgctcttacttgagactctccagagtgttgtctttcgacaacgtttactatagcatattcccgtgctgaatacaagtgtttttttatgagagacatttttctaaaatctgctcaaactacagttcctgtttcttgacattttattcgcacaaattgcatagtcattcccgatttcctgtgctattatcaaagcatcatcacttactttataatttattaatttttcatgtaaaggagcattaatcatgttaaaaaatacgtttaaaaatccacttctttccggattttatccagacccgtctatctgtcgtgtaggcgaagactattatcttgttacttcttcttttgtttattatccaggacttccgattttccacagccgtgacctggtacactgggaacaaatcggccatgcaatccatcgtccggaccaattagattataaaaattgtgagacctctttaggattatgggcaccaagcatccgttaccacgaaggtacattctatattatcaatacttttgtgtccgagggcagagaagccagacgcgataactacattgtaaccgcaaaagacccggctggtccatggagtgacccggtatttgtagagggtgcagacggaatcgattccagtctgtttttcgatgaagacggaagcctctggtatgtgggaaactttatcagtgaagaatgtcgttatgagggacaccacggaatctatctaaatgaattagataccgaaactttccagtttaaaggcccacgctacattatctgggatggtttcaaaaccagaagtaaatggattgaagctccacatatttataaaaaagacggctggtattatctgctggttgcagaagggggcacatttgtaaaccacagtgtacagatggctcgctgccgtaccatcaatggtgactatgaaatctgtccgagaaatccaattattactcaccgtcatcttccgatcgaaaatccgatttctgttaccggacatgctgatattgtggaaactcagaatggagaatggtggatggtacttcttgccgttcgtccttatgtcggaggtcattacaatctcggacgtgaaaccttcatggttccatttgtatgggccaaagatggctggccgatgattgacaatgaaaccggaatggttcagaccgaagaacgacttccaaatcttccaagaaccattctgcctctgattccgactaccgataattttgaaagcgaaacccttgcaatgcagtggaataccattcatccgccggtagaaccattttattctctgacagaacgtcctggatttctacgtctttccacccgcccggaagtgcttgaagaaatctgtactccatcttttgttggacgacgccagcagcataaaacatttttagcccgcactgccatggaatttattccacagacagaatcggaagaagccggtgttgcgattcttcaagatgaccgctttaattacattatggttctaaaagaaaaagacgatgaacttgtgctcgagcttcacaaaacagaaaatggaacaagaagtctcattacctctgctcctgtaaaaagaagtaaacgtctgtatctttctattcagggaaatgtaaccgactacagcttctattatggatatgacgaacaggaaatgactttacttgcttcaggtcttgatgcttctcttttaagctctgttgtaaacgaaggatttaccggtgcttatatgggtatgtatacaagctcgaatcataccgaaagctttaaccatgctgactttgactggttttcttatcagggtgaataattttaatttttgcctctgcaagtaaaacatacaaaaaatggcccacagaaaaaactctgtgagccatttttttatttaaacgcttctgctatctgttgtaccagagcgtttacatctgcattttttaccagatatcgttccgttccattgactgcaacactgtcataatttccatcataagtataatacgtcagtgtaatttccggtgcttcttttgtacttctgtggaataccatacgcagcacttcttctttttcattatccgccttcggagtatctaaattagaatccagcatcacattcaacaatgcctgatatagggttgtaaaggtttctttttccacttctttatcgcccatataatattttccatctttgattttcattgtataagaagattcttttgtcttgatgtcaatactttctacggtatcaatatttacaagtgccggaatttttaagatataatcaaacggatttaagttgtaaattgcttcaagtgtactggtaggaattgtatacacttcattttcatagcctgctactgccacataacgatttccaaggtcatcttcatttccaagcagtaaggtaaccgtcttatctgcttcggcagaggtatcagtactctctgtataatcaatctgcatcgttgttgtacttcccgctacaccagtatctgttccatccggaacttccgcagttgttgaaaaatcaaatccgcttaacacatcaaacaatttatacatggtttccgtatttacagtcgctgtctcatcgtaaggatttaaaatctcccagtaatcaaactccatcttgtaatcggccggttcttttgacaaagagaaaatttcttctccatctcggttaagtacgagtttacggattccatcagaagtaaaagtcgggtgttctgtcttttcaagttctactttcttttcctctgtcttttcctctgtcttctcttcggtttccgttttttcctcatctgcagcttcttcggttttttcttccgcttcgccattcgtatcttctgtattttctacttctttcgtgccttctttttctgttttatcttcgctttcttctgcttttgtctctgttttcgtttcctttgtttccgttgtctgcttctgacatcctccaagtgtaaacatacttaatgatgctataattcctaacaacgcaattttttgcaatatttttcgcatattctttttgtccatcctttcttacccttttctattctgttactttttctttaatttctctaaaaaggggaatctcttcggattcccctctatactagcacgttctcttttaaatggcaaaatcaatttttaccgatttgcatctcccttaaaatctaattaactatttctgtcacttcacaggcttcttctcttcccgccagtaccagatttttagaaaaagcctctctgatatcatggcagaatccaccaactctattgacacacccctctctaaatggtacgattttcacaaataatcacaaaatttttagagatgtaggtgaaaaatatggactatcaaacacaaatacaaagctttacagatgagcagcttgcaactcttatcgacgatgaaactgctacagaaacacttggattagaagctgataaaatacgtcgggaaaactatggaaacgaagtctatgtacgtggtttaattgaattttcaaattattgtaaaaatgactgctactactgcggtatccgaaaaggaaaccggaaagcagaccgctaccgcctttcttttgacgacattttatcctgctgtgaagaaggatttgctctcggtttccgtacctttgtactgcaaggtggagaagacccgtggtacacggatgagaaagtctgtcagattgtttctgctattaaagaacgctttccggaatgtgccgtcacgttatcgattggagaaaaatcaaaagaaagctatcaggcttatttcaatgccggtgcagaacgctatctgcttcgccatgagacagccgagcctgaacattatcagaaattacaccctgacagcatgagccttgaaaaccgcaaacgctgtctctttgatttaaaagaaatcggatatcaagtcggttccggattcatggtcggctctccttatcaaactgccgaaaatctcgtttcggatcttcgatttttgcaggaattacagcctgatatgataggaatcggaccttatattacccatcaggataccccgtttgctgaatttccaagcggaagcctgactaagaccctgcgtctggtttcgattttaagactgctctttccttatgcactgattccatccaccacggcacttggaacaattcatccggaaggacgagaactcggcttaaaagccggaggcaatgtcgtcatgccaaatctttctcctgtctcggttcgtaaaaaatacgaactctatgaaaataagatttgcaccggagaagaagctgcacagtgccgaggatgccttgaagcaagggtaaaaaaagcggggtatcagattgtaacggcaagaggtgatgtaaaaaaacattaaacataagggacggagttcgtggcaaacgccataaattccgtcccttatttcttactgcagtgcctgaagcatctgaagcattgtcatttttgtaattggatgacgtttccacggtgcaatttctgccattggaattaatacaaaatcacgtaaatgcatttcaatatgtggaatatgtaaatccggtgcatcgattacttcgtcatcatagagtaaaatatctaaatccaaagtacgaggtccccagtggatgattcgttctcggttagcatccgcttcgatttcatgaagcagatcaagcagttcataaggtggcagcagagttttaagttccaatgctccatttaaaaaatcatcctgttccactccgccataaggttcggttacaagataatcagaaacctgaacaacactgcagtcctctgctgcatcaagcaaggcaaccgcacggtcaagatatgcttttttatcacccatattagagccaagagcaatataggcagtatgccagcttctgctgatttcgactgaaacggtatcaagtggaagattgattggtgcccatggtttttttactgtaatatctacctgcttcacaagagtagaataagtgactaagattgtatgagcaacttcttctgcgattttttcaattaaattccaagtatttccctctacgattttttttatcagatgggacacttccccatagttaatcgaattttcaaggttatcggttaagcctgccatgcgggtgtctgtgtgaagaactgctgaaatcacaaatttctgtcccagaaaattttcctgctcatacacaccgtggttggcaaatacttctaaatctttgacagttatcttatccataataagttctccgattcgttattagtgagcaagaattgcttttgtcatctggatgatacgtttgttttctttgatatcatgcacacggacaaatgcacagtttttcatcacaccgattacagttgtggcaagtgttccttctacacgctggtcagccggcagattcaacgtatttccgattacagattttctggaagttccaagtaaaattgggaaaccaagtctgtgcagaacgtctacatgattgattgcagcgaggttcatttcataagtttttccaaatccaacacctgggtctaacatgattttatcatcagcaactccggcttctcttgcgattttaacacattcagccatctcacttaccatgtcttctaagaaatcattgtaaactgcttcatctttgttatgcatcagacagcaggctgcattatattttgcggtcataagtgccgtttttttatcaaatttaaagccccatatatcatttacaaggtctgcgcctgcctgaagagcagcttctgcaacatttcctttataagtatcgattgataccggaacatcaaaacgagctttgacagcttcaataatcgggacaactcttgcgatttcttcttcttctgaaattacgatatgtcccgggcgtgtggactctccaccgatatctacgatatctgtccctcctttaatcatttcttctgcatgatgcagagctgcatcaagattattaaattttcctccgtctgagaaagagtccggagttacatttaaaatccccataatataggtttcattttttacatcaaattcacgatttccgattttcatagtcttttatctccaaatttagtatttaacaaattcgttctaataaaacaacgctaaatttttcttggtatccggccagttacattctttgattgccggacatgcaaaacagttccgagactgtttgtctgcacggtaaagatattttgcaagaagagaatcctcctcagaagattcttttctgtgaccggcgatggcttctgcaacctgtataacttcttctttagagaaatcacagaaagtcataatttcatccgctatcctcgcaccggaaatatggtgtggagtaccaagtgaaatctgttcatagcgtccgatatcatgcagcagggctgccgcatagatcagttctttacttacgtttgttttttcttctaaggtatagatgtacatcagtcttgcaacatcaacaaaatgttccattgtatgacggcagaactcacgatctttttctgcatcctgtaataatttaaactgttcctgatacaatggatgatttaaaattttctggattcgttccataaatgaatcaaccttttaccatctggaagaaagtctgctgaaggttaaagtcttctgcaaaagcaccgcgaaccatagttgttacggttttgcttcccggtttctgaactccacgcatggtcatgcacatgtgctctgcttcaatcataaccataactccctttggctgaaggtgttcttctaatgcatctgcaatctgtgcagtcatattttcctgaatctgtggacgtcttgcaaatacttcaacggtacgggcaagtttgctaagaccagctactttttcatttggaatgtaagcaacgtgtgcttttccgtagaatggaagtaagtgatgttcacaggtagaatagaacgtaatatctttttctactaccatattgttgttggttgcatggaactgtttttcaagatgtacacctgcatcttcataaagtccgccgtaaatctgttcacacatgcgggcaatacggtccggtgtctctaaaagtccttctctgtttacatcctctccaataccttctaataacaggcgaacgccctgtttgattttctcatggtccatcatttctaaaaatcctcctctaatataaatgaataatgtttcgggatgtaagacaagaaaagtttaaaagacacaaaaaaaacatcccgatgtgaataagtcatctggaataaataataatttttatatcccttcacaatcgagatgttgctgtcatctgtgtgttgcaacgggtgcggactccatatcgtaagacgagcttttcgtttctgcggcaactccccatccactgaacacttaacgcatagaatcctattttgcatattatttatctgcggctattatagcatcgagtacagaagaaagcaatagaaatccgtagtttgcaggggggttttggaaggtttttcctgtttatgtaaaattcaaaagaagggaatgtaaaacaatgagacaaagaatctgaaaattaaataaataagtagaaatagccgctaaactgttggtatgatataatattaatgatataatattaatatagaaatctaagaaaactatttgcgtattcatttttttaattctttcaaggaaaggggaaaatgtaatgaaaaaacagaacaaatcctctattgtatggtttattcttagcgttattgcaatgattttcttgacaatgcgagttgcgatgaactgggaattgaagggtgcagtattggtgttttttatttttggtatcgtaatagaaattatctggatagcaaaaaatataataaaattttttcgagaatatgaataaaaagcctcctgattttagagtcccaaaaataaatgggccatcctcaaactagattagcccatttattttttatttttctcgatttgccaattcttctgcaatctgtggcatttcacggtctaatttataaatcaccagcataattgctgcaatcacccaaatgatgaccggtccccatttatagatatcagcaatcattgaaatcgcacttcctggctgtactacatctgttccctgtgaactgatgtatccacttgcagtcattaaagaagtaatcactgcacttgcaattcctgaacctactttaaatccaagacttgcgcctccaaaaatcatgctttcctgacggaaaccatttttccagtaactatactctaccacatctcccagcataccaaatactgtcgcatttagctgtgctacaccggctgaacgaatcaatgtaatcgcaaacatatagtagaagttgtttggatttagcataagacatacctgcgctgcaatcgcaactactgcaccggcgagtgtaatatttcttttcccccatttcttgataaacacaggacaaaccatcgcacccaaaataattacaatcgtctctgcaaaatataatacactgtacatccatgaatcattatggaagatatatttacaataatatggaaggcttgtaccaataattgtcatgtgagtaacctgaactgtccacaataccagtacacaccagaaatatttatttttaaccaatgcttttaagtgagtcaataccgggattttttctactgtttttttctgctctgttgttatagtttcttcacattttaagaagcagaataagagtaatgccatagcaatgacaacccataatcccattgttttaatccatgcagcctgatcatttccaaataattttacgattggcattgtaaaagttacagaaataattcttccaaacggagaaataatcattctgaaaattgataataaatcctgctgataagaatctcttgtcattaatgcagataatgcgccataaggtacattaattgtgtcttataattaatttctcctgttcccggctcatgacgtcccggtgcatctgcaacgtgaatatgaccaaactgatctccataatttgtaatggtgtcgcaaatacagctttcattaatctgcatatgataaatatcataaagtacttttaatcttggtgaaccgatcagacgacaaatttctgctgccatctgtgagcacttggacttgaaaaagaaatcaaagtaatctgccatgacgttgctgctaacacaaaacttttattagaagatggaagtattgatttcacaattactcaaaatctttatcgtcagggttacctgccgattatttacttaaaagaatatttaaaaaatgatacccttccagattctacgaatattacacctcatatttctattatctgttcgcaaaatatttaactcagattcaacacttgtaagactcatcgcatgattacaaagaaaaaagccatcttttttaatttttttaagatggcttttttctttttcacaaatttttcacatttttcctattttattttttatttgtagtgttataatacagatagtgcatatagaacttctgttatcacatcttctatacctacacgaataattattttgatttttcaggaggaatagatattatgactacattaaaaaccacaaaaagaaatccggaagtaaaagcaaaaaaattaagacgtgacggttttgccacaggtgttctttacggaagagaaatggacgaaaacattccgcttcagtttagtgcggtagacgccagccgctttatcaaatcacataaagaaggttctcaggttatccttgatttcggagataccaagacaagcgctatcgttaaaaatattgattacgatgcaatgaaacgtcaggtaatggctctggactttcaggcactggttgccggggaagcaatttctacgactgttccggtaaaactggaaaatgaaggcgctgttcagggatttgttgaccaggaactgactgaaattcattacaaagcagaccctgcacatctgcttgagcctattgaaattgaccttaccaaattccacacaggcgatgctctgtatgtaaaagatttgggtctggaagaaaaaggtgctcagcttatcacaccggctgattccttaattttccacattgcagaccatgctaaaaacatggaaattgctgaagatgaaacagctgacgaagaagctgctgaagcctaagtagtaaaatgaataaaggacggagtttatggcgtctgccacaaactccgtcctttattcatttttttattaaatctccaccttttctaccctccacttcccatctttcagatataaaagagccatcgacggtgcatcgaaaaatcttttttccccacaactgcctggattaagccaaagccttccctctttttctctttcttcatatttatgagtgtgaccgtaaatcacaatctgcgtttcttctaaattccaaggcacatcttttttctcatgtaccacacagaaattgactccgtccagtgtaaaacgctgacattttaataagtgtgacgcccatgcgccatcattatttccacgtataaaatagacgggtactcttggctttaaatgtataaaaatctcatctataattctctgagaaccgatatctcctgcatgaatcagcgcatcacagctttcaatttgttcaagcacttccggtcgtaacaatccatgcatatccgatagcactgctattttcatctaattactccttttctgttttctttttattttaccataataaaaaagccatggactaatattttgtccacagcatttttattttttctgctatctgttgtaatttctgtccacgatatccaaaaatcctcactgctaaatctccactgcaaagctttgtcacaccgccgtcacattctgattccatttcaaggatttcccagattctttctgtaatttcagacatcacttttccgtcctcaagttcggataaaaacaggtttgccacatgcgtatacccttcatacagaccaattttttccatcggcattttttctggttcatatctggtattgtcccggtaaatcatttttccacttcggtaaatcgtcacttttgaagcaaactttcggtataaaaagcgttcttcatgtgccgttcttccacaggaaatcacatccagaaaaaagagttttgcactcttatcttccagttgaatctccatcgtactctcgaaagcagaatctgcaaatggaatcaccggctgaggataataatataacaccgaatctttttcgacgtttactttgatatttcttttcgcctcaccgccatccattttatggattttttcaaatgactgcgacagtacttccaagtctgccccctgtcgtacctgataggaaaattcctgcaaatcaccgctcataattccggcggatgcacaaagaggcatgacctgaatcccgccattttctttctcaaatggtgtcataatcttatacggggcggtaaaggatacatcctctaaaatggtttttccgtctttttttcctgcacagattgagacacgggatacttttccgaatttattttccattctacatgccctctaagaatacgtttttcttaatccactctaccacaatatccacattttcatccccacggatgttggtaaacacaaaaggacgctctcctctcatttttttagagtctctgtccattacctcaagacttgctccaacataaggtgctaaatcaattttgttgattaccagcaaatcagaacgggtaattcctggaccgccttttctcggaattttatcgccttctgccacatcaatgacaaaaatcgtcgcatcgaccagctccggactaaaggttgcagacaaattatctccaccactttcaataaataaaagttcaatatccggaaaacgctctaccatctcatccactgcctctaagttcatcgaagcatcttcacgaattgctgtatgtggacatccgcctgtttccacacccgtaattctctctacaggaagcacactgttcttcgccagaaactgtgcatcttctttggtataaatatcatttgtgataacagcaatgctatattcttttgccattttccttgataaggcttcaatcaatgctgtttttcctgaaccaaccggtcctgctactccaatttttacataagacatattgctttcctcactttttagctcacatttactttttacgacatatataatctggaatacagtttttcatgctgaattccacggatatcaaaccccggcgcagacagacaaagctcctctttggtctgtgtttttaatgtttcaagcacttcctgaaattcaaaaaagcatctgcttaacaacttttgccctacactttgacttaacggaatcgtctttacacagtttgtcaccattgcagaggtctgcgcataaagataatgttctaatgcttcttctaactcaattccaagcgccgaacaaaacactccataaacacagctgtgactgatattttttccttttcttgctgtcacatactctttataaattcctgtttcattaatttccaaatccagtttttcaatcgtctttacaaaccgagagcccatttttctgactgcatctctttgttccatcggaattctggatgcctctaaaatttcttctaattcttccagttcttcaagacgttctgcctctgctgactcataggccagctttaccgaaagcagttctgttgtagcaaaattccatttaattttatttttaatatactcttctgctgttttttcatcatgtacaattccattttgtatataagcttccaatccctgtgaatgagaatacgcaccaattggaaataaagcatcatttacctgaagcagataaaattttttctgtgacatgtaaacgtctccttttaatgatgatgattatgaatggaagcagaaatccgtttatcaaaatccaatttcatcacttctttttctgcttttacaccatgaattttttcaagcatcacaagcattggctcattataaatcgtaataaatgtatcattttcaccccaaaaaagcggtgcatgacggtttccaatttcgtaacataccttcgcagacatcttctcatgtcccggtatcaaagtcacacgaatcacttcacatggaggggtattgactaccactaattttttatcatctgcatagatgacatcgtcctgataaagaccgcgggaaagaatggaatcatccattcttatcccaacttctgtgcctttatctgtatttttcttatgaattcttttaaatgcttcatgccattcaatatcaactgtttcgatttcttttccggttgtatcaaactcattaagctttccaagtacctgttcgcacagcatattttttcctcactctctaccaaacctgtaacagcatcataacccctggaatccaggcagttaccacaccttcaaagacctgcaggcaaggtacaaattttccaagtttctttcccataatgtcctctacaaaagcagttccccacagaattgcccataagtaccagatagcagcccagcggatatctgcagtaattccaagtgcactgcttcctgtgataccctcgattgtaccaaatactacggcattgactgctacaaatgtagaaaaccaggcaaacggaatcggacttaattttaaaattttactaaatgctacaaataaataagtaaagcagaataacagtccagttcctgctgcataataatttcccataacgagattgacaaaattaataaataaagacaatccaccggtcaaaatattcatgaccgctgtagattttccatccactttatataaggcgcacattccgttattaattaatacaatccctacaaataaaagacaaactcccagcataagctccctcctgagtattattttatttatgtcaattgaacgtaaaacttgaatttagaacaagctgtacagctgtgtaagcggcagtctttcagctggttttgaagtaatttcctcgccgtctaccgtcactttataagtctcagggtctacggtaagttccggtgttctgtcattatataccatatcttttttaccgatggtacgacaaccttttaccggaacaactatcttttcaagaccgtatttttcttttacattttcatccattgctgcctgtgaaacaaaggttaagcatgcttcattttttgcttttccatgagcagcaaacattggctgatactgtaccggctgagtggtcggaatggatgcatttgcatctcccatcttagatgccacaatcataccgcctttgataatcatatccggttttgctccaaaaaatgccggattccaaagtacaaggtcagcaaactttccttcttcaacagaacctacatactgtgcgattccgtgtgtcagagccgggttaatagtatatttggagatataacgttttacacggaagttatcattttcatgaccttcatcttctggcaatgcgcctctttcatctttcattttgcttgcagtctgccaggtacgggtaatgacttcaccgacacgtcccattgcctgtgaatcagaactcatcatgctgaaaattcccatatcatgaagcacatcttctgctgcaatggtctccggacgaattctggaatctgcaaatgctacatcttccggaatctttttatccagatggtggcataccataagcatatccaaatgctcatctaacgtatttacagtataaggcatcgtcgggtttgttgaggatggcagtacgtttggtgctgctgccgcacggatgatatccggtgcatgtccaccgccggcgccttctgtatgataagtatgaatcgttcttccaccgattgctgcaagggtatcttcaacacatccgccctcatttaaggtatcggtatgaatggctacctgtacatcgtattcatctgcaacatttaagcagtgattgataaccgccggtgttgcaccccagtcctcatggatttttaatcccattgctcctgcttttacctgttcaatcaaaggcgcttcatcggagcagtttccttttccaagaaatccaagattcatcggatattcttcggctgcctttaacatcattcttaaattccatggtccgggagtacaagttgtcgcatttgttccatctgccggacctgttccaccaccaatcatggttgtgactccactgtaaagcgcacagtcaatctgctgaggactgatgaaatgaatatgggtatcaattccacctgctgtgacaatcatgccttcgcttgcaagtgcttctgtggatgcaccgactgtcattcccggtgtcacaccatccataatatccggatttccggcttttccgattcccttaattttgccatctttaattccgatatctgcctttacgattcctgtagaatccacgattaatgcatttgtaataaccaggtctaagtctccatctttactacaggtttttacagactgtcccataccatcacgaatggtttttccaccaccgaatttgacttcatccccataagtggtatagtctttttctacttcaattacaagactggtatctgccagacgaaccttgtctccgacagttggtccgtacattgctgcatatttacttccggaaatttttacactcatcttcgtacctccttacagaaatccttttaattttgctgtttccatcgatgtcgctttggtatcttcacctgtctgggcacgggttaaatcatttaacccaaagacacgttttcttccacccatctcggttaactgtacctctttttcttcacctggctcaaaacgaaccgaagtaccggatgcaatatccagatgatatccataagccttttctctgtcaaaagacagacatttatttacttcaaaaaaatgataatgagaacctacctgaaccggtctgtctcctttatttgcaacaagaatggttactgtttttttgccttcatttaatgtaatatccctttctgccggaataatttcaccaattttcatctgattgcctcctttactgaatcgggttatgtactgttacaagtttggttccatccggaaaggttgcttcgacctgaacttctccaatcatatctgctacaccttccattacgtcatcctttgtcagtatttttgtgccaagctgcatcagttctaccaccgtttttccatctctggcaagttctaaaagttctgaactgatgtaggcaagtgcctctacataattcaatttcagtcctctttcttttctctctttcgcaagatttcctgccatgtgaagcattaatttttcctgctcttttggattaagcctcataacatttcctcctcttaaaggttctaaaagtcagtttttaagtctgcaggtttttgaaatttcaatcgagcgtaaacaaaaaaagcagacaaacagcaccttacttcaagacgccattgtctgcttttaaaatcccttattcttttcaaaaactctacccgcattatacacgaactactttttttcgtcaatcattttcttctctaattcgataaagtttacaatttattcagattttgcgaaactcattttcactataccatactctgtccttttcattaatatccagcgcatacaatttttcatcttctatttcaattacgattgtatgctggttttcatcctctaaccacaccttatccattgccggttttccctccggacgcccctcacagccaaaatccggttcatcaatcctctttacgaaatattccattttttcttcctcttttcctgttttttgtattatttaaataaaaattatagcaggtgtttctggtaaaatccattctatgtttctgctaaaatccattccgagtcttgttttactctttcacttgtcttataatcgaaaccgaatctaatgaaaagaggaaatttttatggttaccctacttcttaccgaacagctcactgtgctatttctcatgatgggctgtggttttgttcttgtaaaaacaaaaattgtaaaatcaagagacagcaaaaccctgtcccttatcagtgtctatctgattatgccttgcgttattataaatgcattccagattgactattcaaaagaaattcaagatggatttttactggcactttttgccgctgttatccttcatcttctattgtttcttatctgcggaatccttggaaaatttttaaatttaacttccgtagaaaaagcatctttgatttattccaatgccggaaatctgattattccgcttgttacttccgttctcggaagcgaatgggtcatctattcaagtggatttatgtgtgttcagaccttgcttttgtggacacatgcacagtccattatgcagggaaaaacagaatttaactggaaaaagattttgcagaatgtaaacttaattgccattgtagtcggaatcattctcttctttttccacatcaaacttcctgttattctatccgacaccattaactcccttgcttctttaatcggaccggtcagcatgattatgcttggaatgttactcacagaagtagactggaaagcactgtttacttccagacggatctacttaatgacagcattaaaaatgcttgttctgccacttattatggtcggctgtatgcggattcttgcgcatcactgctccctcgcaaatgcatctacaatactgttaatcagcctgcttgcaacgatcactccgtctgcgacaaccattacacaaatggcacagatttatgataatcatccggattatgcaagtgcaattaatgtatttacaacagttgtctgcattatcacaatgccaatcatggtattattatatacactttaacgcaaacacccctgtattctgttttttcacaaaatacaggggtgttctatcttcataattcacttttaaaatggtcttggagagccacaatactcacagaatcttccggtattttccgcaccacactgacatctccaggtaccacctgactgctgcatattattcatgtctcgctgcatgccctggttcattccctgattcatgccttgattcatgccctgattcataccataattcatatcttgctgcattccttggttcattccccggttcatcccctgattcatgccataattcatgtcctgctgcatgccttgattcattccccgattcatgccctgattcataccataattcatgtcttgctgcatgccctggttcataccataattcacaccttgattcatgccataactcattccttgattcatgccttggttcataggcattccactctgcattctcggtgcctgtccggtcagcgccgctataatttcatttccgacacgttccatctccatcatctctgctcgattttcctgctcaattgcaaaactgtgtaactgaaaatccatatcatcaaaccatggagatctcacctgaatcttcatactgtaataatactcgtatttataaaccggtggctgataactgactgtctttccatctttcgtatatgtctcttcgatccgatcctgttttacatccatattacactgaaccacatctgacagtgacagaatatccggattttcttttgtatccaggttatgcgcaatggtaaaatttccctgcgtttcatcaagaaataccgtgtacttttttgttgtgatccgtcgtgtgatacggaaattctgtactttttccttatttgcttcacggtattctaattgttgtttaatatcctctacggtactatgtctgcgttcctcaaaccatggagacagcttcttcgcacattccttacatagatttccatcatctagtttgcgatttccaagcaatccgattttttctccacagatatcacaatatttcttatcgaataatcccatcttattcctcccgtctcttacatactttcagcatcctactcttcccctgcactttttacacatttgaaggtcagataatcatcttcatcactgtattgaacagacagtgacccatcctcttccattgtgataagtacattctccggtgcctcatcatccatttcgattgcataatatccataaagtgcagaccacggataagtgcctaactctgcgcctttataaatcacctgtactgtgcgatcttttgcgaaattcaaacgcattgcatcattaatattatctacaccgtccagtgtcgtctgtgcttcctcgtcaagcaactcttttacattttctgaataccattcaccaatcactgccaattcatcttctgacagataattttccggatttgttgcatctgtcccttctcttccgaagataatatttactccctgtcccagcagatcatcaagaataagggtatctccatcaagggtaactgacatttcctccccttcaatttttaaaacggttttttcatctttctttgccagttttccggtgcctttgtcattgtcaatcgtaaattttacttttccgctgtgctctatttcgagatttacatccccctcaaaacactcttcaattggcatctgcgttccaagcgcttctgctacaaccgcaatccatttcccctcatatggattctttttcgcagcttttccacctcctccacatccgattaaggataacgtacttacaaccagaatcacgctcagcaaatatcttatactcttcttcatctctttttcctcctttgcataatgtgattttctcttatattcacattatacaagggaaacactatttgttcactgttacttctgatagtaatttaaaaattatctgatttttattaaaaatatcattttaatgtcgtaacaatcaacttactttccaatgctgcggcaatcaaatcttctttgcagctataaccggcttttgaaatcatttcctgaaaattccaccttacgcctgcccttgaacaattcatcttttgagcaatctctgcataagaaaatccacaaatatacaatctcagcatctctagctgccttgggctaatttccccgctcgtaatccagtttaactccacactcggcgtaacatccggaaaaacatgttctccttttacagtgcgccaaatcacatcccgaatttcttcctctccatgatctttataccaaaggctgtccgcacacccacttttggcacgctccagcaccttcggatcaataagagaagtcacaatcaaaatctttgtatacggacatgcctctttgattgcttttcctgcttttaatccatcatgattatgaaaggtctggacatccatcaatacaatatcaatcgcggaataagtacaaattttcactgcttcctctgcatctgcaaccgtatcaacatgtcgaaattccggatcctgcaaaaggatatactcaaagtatcgttgcataatcttttgatcttctacaattagtacacgcaccataatttttcccctctttcaatcctgtctccactgcttactttgtctttggcatctttataagtaaacaaaactctggctcaaacacggtaaacatcctgcatccttctatctccaatgctctgcgaagcgcggataatcctccaccttctcttgcacctttttttggaaccattccatcgtttgtaagcttaagcagatattccctccaatcttcttctatcttcacatttactctttttccatgtgcatgcttcgcacaatttgtcacgcactcacgaattgcacggtcaagcaaaattcggtatgttgaattttccggaacatcgccttccagacaaatggtaatcccaagttctttggcatgcttttctgtatcctgatataagtcctctaaattttcaactgtcatacttgtaagaatatacacttgttgccttaacaaatccaattgtttattaatagaaagggtatcttctgtattttctttattttccagaattcttcgtattgtaagcaagctgcgcccaaaattatcatgcacctgcattttcattgccaatgtttcctgtttgcgtattctctcgccaatcttttcatacatttcttctaattgctgattcagcgtttccaatttttcattattaaacttaattctctcgctattataataaatttcggaaacatcaagcgcaattgcctgtctatatccagccagttccctgtccttaagctgatactcctgaaacatccagactttcccatccggaaaagcaaatacactgccatcagaactcatcgaaatgatctcttctctgaggttaccttccgaaatagcctgatgcagcatcttataattctgtaattttgttccaagcagcattttgcttacttctctcatcttggaattacaaagaataatctgatcaaatgcattcgcaaaacatacgccgcatggcgcattgtctactgcttcttttactgaccatggtgacaacctctgtttttctcgtcttatctccttgaaaatgctccgcaccagataaaaagtcaatcctgcaattccgcataacattaccacaatcggaacattcaaaagaagcgattgctccagcgcttttgcatcgtatttctgtacacattgcaataaaaccgttcccaaaaaagtaaccccaaaaagcacggttactgtaatttttcttcttaaatgagcagaaccggtcattcttaaaagtataagaataaactcaagcaccagacaaaattccataacactcattattaaattttgtatttctacactgcactctataaaattcgacatcgaatcagccactctttctcgtcttcttgttctacttctgcaccatgttgcccggaaagcaatgcataaatgtcattttctgaaataatatttaccgagataatcaaatgtgcctccatctcaacgacacgaaaaaagatcatttgcattcgatcaaacagttgctctaccagccactcaaaataatcataacatttaattaattcttcatcatggaattccagattttgaatattcacataataaagtgcccggatcttgcacaactttaatgccatacacgattctgccagactctgtatcaaatcctctgttttcagtgcttccctattttcattcttttcattatgaagcgttaacgtaagattttttcgcctttttaaataggttccgacaaccacaatcttccccagaagtcgttcatatacttctttcgactcggttttttccagttcttccataaagtgtgaaatcagttcaatctgaccggccgtctggctttgtatcaaatctaagagccgattttgttcttccacttttctccgctttgcctcctgctgatagttcttttgcaaaaggcgatttcgctctcttaattcttcttgctgttcttcaatatcctgatactggtccataagcaaggaaacatcctctgcccaaaataaatgaccacctcgcactaacaaatgattcattcgtgttccattttctatcacaagggtgccaactaaaagtgtttctcttacttcctgtggtatgtccaaaaactttcctgaatgataacatttcttaaagctccaatcagtaatctctgcatctaatccgcccgcagcttgaaacaactcaatatacctgctgttaattggaatcagtccacagataatagaactctgataaattgcggccatcaaaaaacaacatactgcggtcatatctcccacatatgctttaataaatggcatccccagaatatgacaaagattccagccaagcaataaaagtcccggaagcaccggaaaccaggtccactttcttccggaagcggcactcttacgcatcaacaccacttccattatcatcagacacagcatcatccaaatctgaatcaaaataaaaataaagcgatattcatagacctcattggaaaagaaaaatcctttcggaaaataaaacactttttgatgcaagtcatttgtcaatactgcaaaaatcaaacatagtgccggtattattaaacatgcactttggttttttgtattttctccttcttctttatccattaataatgccgcattaagcccgagtgtcggaatcaaaatcataggaatataataaagataccagcagatgcgcatctctaacggttccatgaaaataagaaacttaatcgttcttactaaaaaccaaaaaaccataagacaagcaatccacgtcaaacattgacgcattttcgcatccaccacatgtttctccaaatagatgacccaggcacaatataaaccgatataaatgctacttcgacactgaccggcaaactgaatcaaaaataagcttttaaatgagatctgccgacatatgtaagccaatataacaaggctcgcaattgcgatataggataacagcctttttttcttataagacatctaagacatcactcattcctttcttcatctgaaagcaatttcatatccaatcgtattatctttattgtatcatattcgttttccaaaatcgaatcccaactgtcgctgaacacaaagcgtaaatatgacacaactcaaaagcattaagtattgaaattttttttcatccatcatcccactcttctatactaaaagaataaaaaaaaagtaaacttttgtcactatcgtaagggctagtgtggacgctttgaagtcatgtgataatataattgaggtgattttatcatccgcaaaaaaattccaaaaaaattgaggtgatttttatgatttcttcctggtcagatgcaattggtctttccttcgcctggtcctttggatggggacttgtacttacctgctatgttctggattggaaaatcgaatggatgcagccaaaactttggtttctttttctaaaaaggaaactaaataagacagaagatttctttttgaatgcttctgcaattccaccaaaagtactaggcgcatttaagaaggttctctcgattttagaaaccggagactttcaaaattcatctgcaagtatcggacaatcttaccgaaaaaagctggagcatgaacttacattgttgaaaaaaaatgaaatcaagcatgaaattcgcatgactcatttaaaactgacagaggaaaatgaaaagaaacaagattttcgtcattggagcgacgctggacgtgaatggcgcgaaatcgtacttcagggcacggtattaaacagatatcgaagtctcaaaaacggaaaaattttatatgaagactttttcccacatggctctgtcctgcttagacagtccagacacattcgccatgacgaagtggggagcaaaaacagaaatgaagaacaacagttttatgctcagtatcaaaatattatttgtccaagctgtggtgccgagattacattaaaaggggacgaagcgcactgtccttattgcggtggttatatcaaaagtgatttctttgattggcagacagaagaatttttagtttatcgaagcctgaatccgaatgcatcctattataaattagttcttgcaaccatactcacttttttctttccgtctattccttgttttcggttcatccataacgattatctgatgtttggtactgcctttgcgcttacacttttactggctggcgcaatctggattttactcttaaaacaagaaaagaaagctcacgtttcgactgaccaaatcgtgcgttacgatgaaaaagttttaattgtagatctcaatgaagcactttatggtaccgagctaaccgccgatgccctgttttacagtgtcgataaactacagctgaaagacgtagaaaacacagagaatcgcacaacgattaccatttctgcagtgctgcacaaacttacacttcagccaaatcaaaagattctaaataaaaatgaaaaaataactttaaaattgtacagagcccgttatccacgacgcatgaaatcaaaaggacaagcagtgtttgaagaaaaagaatgtcctcgttgcggtgcaaatttcatgccggacaaaaatggctgctgttcctattgtggctatcagctatcaatagacaattcaaaatggcgaattgattacgagtagaatatcttatatttagtaagtggctgttgcactaattacttagtgcgacagccactttttctgagtttcacatataaaaaccagcctttctttattttcccatccgttccacttccactttctggttcaaaatgcctttcttccacaccatcacatacacttcaaactctacagaatcctgtgcatacacaaatggctcctgccacagcacttccgactcgattccttttgcttttaatgctttctgtctttcataagcctgttcgatttgttttttatgttctgcgtttgatttctttccaaacgaacgtttcggataattttctgcttctttttgaagctttttatctaagagtttgactaccgcaagatgtcttttttgatgtagcattttcgctataatctttgcaatcgtttttaccggatattgctcataaagtgccagcatctgtatcagcatcttatcctttacctgcattgcgagttctttcatcagacggatggcatcgagattcacttgccagggttcactttttggaacgacatattctggtttaacagaaggatacgagcaataatttaatggtggaaattctgccagcagggcaagctttcgttcttccttcgtacaacagtttttctgttctcccaggtaatccaccttgtctcttagaattgcaatccgatattctaactggcgcagatattcataaccttctacccagaaatgtccgatttttccatagtcataacattgaatttccagttttaatgactcaaaaaagatagtaaataccgaatcttcaccctgatttaccaccagaatgtactctttttcttttttttccaaaactgccttgattgtaccctcataatccggcagatattctcctgtaaatcttgcattttcaaataccagaaaactttccactgcatcgttcatcagataaaccagacgccagttattactgttgtcttttggtgctaaaaattcaagctgttctacctctacaagctgtgccagtttaaaaaattcctccggcatttcttctgataagccttgtaaaacctgtttgtaatataatttatcttcgttgtccattttttcctcattatcttttatggttttgatttatcgtatcataattggagaaatttaaaaagcccccgaatcttaaatccaaaagcttataaattcaaacgttttctataattagagcattatcgtttcactttaaatgcaacgtattttttttcgttgcatttttcgttgcaaattttgacatttttctgctaatcgttgcatttcaaatgtatcaaaaactctcagacttctgtccaagggttctaatttcttctgttttcttttatcttcttctgccttttcctgctgtttctattcttctgctgtttctgttattcttctctttgtttttgaactctcttatctacataagtctcttcgccactttccaggcaaattgcagcaagccttccacttggattgcacgctccacaatctattgcgatatgatttttctcccgataaatgtatcctggtctctcgttttctgcaattagctgggttggagtgtgtcctgttaccagataagtattttcaaaatactgccgtccataatctggtctttcccatacaatatcatgcagagaataatcttctatgtctttctccggtgaaaaatttccaagtccgccatgtaccagtaaataatttttcccttctattgtaagtgtttcatataccagaaaatcttccataaaatccagcacgtccagctgtgtttcctcatctaatctacgaaattcactgattgtcgtctctgctccgttatactgccaggttgccagattatccagaagtttttcgtctattttttcaatcgaactttctgtaatttcctgtcgaagaaatttcaggcatttcagtgccatcacctcatgatttccaacaaggcagactgcattaggcatttccatcaatttcagcaaagcctttatcggatgcggacctcggtctatcacatcacctaaaacatacaaagtatctgcacttgtaaatcgaattttttctaacagcttgataaataattcatattctccatgaatatccgaaataacataagtagccatgtacttctctcccctctgtccgtgctctttttctttattatacctcttgtctgtagaaccccacaagaaaaaatctcgcatagcatttatcttagtcggaaattaagactttcattcatgcaaatttattagtaagctcgtcaccagtcttatatcaccaaaataaaattctattgaaatggattgataactcgctacttatagaagcaggaatcttattgactaagataatgcaaaaatttaagcccccgaactttaagtccgagagcttataagatattttttaaactgcctctgcgattgtaatgcatgcataccgttcatcttcaatgatttttcgcatcatctcaaccggagtcattcctattccttcatccagatgctcaaaaattgtgacagcacttccagataaaagctgtactccttctctttttttatctgcatgaaaggcattgtgacgggaatctacattccagaaaacaacattcggaattgtataaccatttcttttaaatttctttttcatagtttcataaaacagccagtcagaatcataagttgcagagtcaaattccatatctgaaataataattaaagattttggcatttcttcttctggtacatgattttccaccgcagttttaagaatactatcaaaagccgcttccagatttgtattcaaaccccagtctgcctctactgcacaagcaactttttcagctaaagtttcaccttccaaatgcacaatgcttggtaaagcgctaaacgtcatgaaacgattatggtaatctcccttatttctttctgcaaaataaattgcaagaccaaccgaggttgccattggtcgtccatacatagagcctgaaacatctgccataacaagcatattttcatcaccaactccataatccggaagatttctccactgtgcttccaacaccttactatcctcgtttccgtataaaatcttttctactatatcataaggatacagtgttttagaatgaatgttttccttgccttccagtgccaggttgataaatttttcaaatctttccgtatcgtgtctgtcaaatgctcttcgatacttcatcatcgcacgtcccggaacggcagaataatcaatctcatcccaattgttgccacacatttttatttctgtaacatcaatatattttcttaacgtacggattattcttttaaagttataaactggatatcctaatttctctgcagttaaaatacctaattttcttgtttcttctacttttgaatcagcagttttcacccattttgcaagcagagacactggtttgcctaattgaaagttttttaaatcctccagtaactgtcttttcattgcagtccacattgcctcttctgccggtgtaccaatcagatagtaccagtcatcaaaacgaccatattcaccaatgaaatcaatgtttggaatcactgcctccggatgatattcagccagattctttaataaaatctgaaagactcttcgctctccaagaccctctcggatgtctcttgcataaaataaaattttaactgcagacaatggatcttcttcataagccttctcaaataaaattttgattcgttcttcatctgcagttctcagtgcaccgattgttgcaaacaaatccagattcgcattatctgttgtgttcactgctcttgcaccattttctgtatgagttaatttatttgatgttttctctaataattctacgaaattcattttgcttccccctataagttcaagccaaacgccaactcttatgagtgtttgattctacagagttacgatgagtgagggcaggactcgaacctgcacttcgtcctcttctcctggaataaattgctgtatgttccacaaacatgaaacactttttcgtgctttaccattaagctacctcactcagataaggcaggcaggattcgaacctgcatcaatttacttacattaaattagaaataagaaattaaaattgctgtatattccacaaacatgaaacgtgctttatctcatactctaccattgagctactgccttatatttactttatcttgttgacaagattagaataatccttatcttcagaaattggagtggattttttctttttttattattccctcatcaactgagcttatcttatcatactgtcggtacctccacaataaaccgccggtttaaaaataaaacaaatcgttaaagctcataaattattagaaccctcagacttctgtccaagggttctacaattcaaaaattcattttatttcttctcaattaatgccattcttttgtattttcatctgtaacttttaacgtatccttttgtattaagaaaaaatccacaatcgcaggagacgcagcttccgtattatcagaatcataataatattcctgcaatacatattcatccgtttcttcatctatatgcgattcattatacagcaaatgcagttctgttactgctccggtattttcatcaatctttttattaataacagcaaatggccagccttttgaagtcagacgaaactccaactgatacttcgtatctggataagaatccaagaatacatctgatttcgtttgaatataatccgatacctctgccaattcttttttgtatcgttgatattcttctgtcatcggatagccatcttcatcgtatttcgtattctcttcttctgtttgttcttctgctatctcatttaattcgtctaaagtttttccatatttcgtgttcagttcatttattttatattttccatcaaaaaaaagaagaaactgctcatcgttttgctcctctccatagataataatttcaacctggttctttttccacgtaacctgccaggtgtcctgcgaaatatttcccccatcatctcttagcgaaaatttaactttactgattcttttttccccttttttcaagataaactgaccatccgcaggaccgaaaaataatggctcccccactgcctgcatagtcaaagaatactctccatccgaagaaacacttgtgtctacattcgaaactttaaaaacaattagataataaaagattcctacaaagcacaataccgtaatacaaagtcctgccagaatcccaaacaaaccttttattattgtattatgtactttgatacagccgattaccaaactcactgacagcagaatccatatgaatagaattaccatcttattttctccagtgtctttatcaatatctcactactcttttcaactactgtacaattcattttttcaattgattcatcaattccaataattccatttcccagtcactgattctggaataccagatacatccataagcttcacgaattttaatatttaaagacgaacagataattactttcgtatctattcctctttcttttaaaattccaagcagtttttctccggcatcgaaatctccctcttcgccttttctcatcggataatgcatatctgtaataattaaatcaaagggatttcctgcttctttttcctggattaataattctaatccctcttccacattatcaacctgtgtaacatctgttacgccacatctatcatctaacgcttttttgatatcatttgctttatacacgtcatcttcaaaatttaaaattctcatttgcttattctccgttcaaaattctctgatatagttgttggactacccctttggcaagctgtttacaaatttccatttggttggtgcctgacacctttccttttattatacagctacagcttgaagccacgcaagaataaacaaaataattctccataaagcaaaacgaaagcctctaaagctaatattctgaaggctttcaatcaattttttaactgattcgaatttctcttttttcttgaatatcctttggcatttgtacaataattttcttagcaatcgcatcttcaagataatactcatttaatgtatcttttaaatatttttctcttttattccttgttgcgtctatcaacatatctgtaaaaaaacgttcccaacttacatatttctcacattctacatattttgatgtattttctaagatatcatctaaattttcgtattttataactcctgattttaatattaaatattcaaaagattccggaagccaaagagatattctgcggttaaactgcgtttcaaaataatcaacacaattttcaatcagtgcaccaaatgccgcgccatctgcaattactagtacatctttgttatccaacatttttactcttcactcgaaactcataattacccttcatctgccatttcctccgcttccaacaattcttctacatattcccgcggattatgcacaatttttcctgtattcataatttcaatttcaaagtttcctttaaaatgcataatatgcctcaagtatataactaaatctttctgttctgcaattttcaaaatccactttgcacagttatctccgcaatttgacgcattatatacaaaagaatcatctttcaacattaaaataagaacctttactcccccagataattcttttggcgtaatcgctcccaaaatagggctgtcaataatatgtgaactaattacagttgaactgtccacatctaaaatcatctctttgacaaaagaatcttcaatcctctcatcttcatatacattatcaaaatatgactgagcatctttcatatactcagtacccgaataataccatatttttagcatttttctctcccatttcatccttctacttcttagcataaaacggcagaaatatgattactagtatttctgccattttttatcacttcttcacactattcaatccatccacccaattactaaaagcttgaccacaacaaataaattgagcaaaactctcaactttccacctgaagtttctttttttcttacatgtttcttacagacaaatttcttcaattacacattcatgttttttactctttttatcgtagttaatccctgcaagaagtaaatttcctttatactcttttaatgtttccacataatgccgttcttttatctgttcaatcgctccttttgcatctttatcccattttagttcaataattactgctggtttttcgctatgaatttttcttggaataaagcaaatatcagcaaatccttttcccgatggaagttcccgaacaatcgtataatattctcttgcaaaataaaacgccagattaatggtacagctcaatgaattttcatcattatattttaaaatagagatttctcgatgtgccttatcaatcccttgtgcaacaaccacttcatcttttctccacagtgcctctaataattttttcgatgcatctacagaatcaatcacttctttccaatccattgtactgattgcattaatatattcctgagaaacctctttattcggaattgataccgttttttccatccaatgataactcagatatcccaagtgaactaacaaagtcaatacatcatcttttccctgaaatgttgtcatatcattagaaaatgttccaatattaatcggaacagcttctcctgccagcatttttacaatatcatcttttaatccttcaaaattcatgcgaatataaatttttaaggcttcataagtctccgtctgattccagtaattatcaaaaattccacttaacattgcatcaactacagattttggactgtacattgcataagtaacaagctgattttccttcatcacagttaattcatacccatcataccaagcctgtgtttcttcaaaacttctgccatattttttacagagacttctcacttcttcctctgtaaatccaaaaaattctgccatctctcgtggatttgtcatcgagtattctgaaaacatattcaatgcagaatgagaaccatactttttaattggcaaaattcctgtcatataagcaagtgccacatattccttatccttcagccacgctcgtaaaaaatccagatatcgtttctgcgcttctttgtcattttgatactctcggaataagcaatcccactcatcaatcaaaatcacaaaagaatgtttcgtactcgcataaatatctttcattacctgaattaaatttttctcatctctaagccgaacttgtccaaatgcttcctgtaaatcaaatatcaaatatctgcgcaacatatctaacatttcttctacacttgtcgtttcacttagaaattcctgcatattaatcttaatcacatcgtatttatttttatgtttctgataagattcacattctgctatctttaaattctgaaataattctgttgactcctcttctcgctcataataagcagtaagcatatccgcagccattgattttccgaatcttctcggacggcttacacaaacaaatctctgcattgttcccacacaacggttcgttacttctattaaattacttttatccacaaaaatctgagaatttaatgcaatttgaaataatccatttcctggattcaaataagttcccatacgccgtgcctcctaaatttttaatgtactcttattatactgcctttgatttaagccacgcaagaataaacaaaagaattctccataaaacaaaagcctccaaagctggcactctgaaggctttcgttttgttttatggaatctcatcacattccttagctgttattcgtattgttttttactttcatttaatttttcagctgaatttgattgacatctggttccttttattgaaaattataatctatttttcttcttttcgtttactattggtatgaattcctctattctcatctcctgcttcattaactccaaattcgtagtcatttcccggcagaataatatttaaggcaattcctgcaatcgctgcaatcgcaagtgctgtcaaagtaatcgaagttcctgctaccgtaaaggtaattccaccactgaatcccagaccgcagacaaagataacgcctgcaataatcaggtttctggattttgttaagtctactttattttctacgacattacgcacaccaattgcggaaatcattccgtaaagcatgaagctgactccaccaataattgcgcttggcatggtactgataacagcggatacttttggaataaagctgacgataattgcaaacacggcagcaatacggataactctcgggtcatagactttacttaattcgagtactcctgtattttctccataagtggtatttgccggacctccaaacaaaccggaaacagctgtcgcaagaccatctccaagcagagttctgtgaagtcccggttctgcaaggaaattttctcctaccgttgcggaaatcgcagacatatctcctacatgttccatcatagttgcaatggcaatcggtgccataacaagaaccgcagttacatcaaatttacaaagctgaaatcccggaagtcccacccagcttgaacttgcaatagatgcaaaatttaaaattgcagaaccatctggattcttaattccacacgcattcataatcattgccactgcataggaaatcacaacccccatcagaatcggaatgattttaaacattccttttccccagatattaaacacaatgataactgcaagagcaaccagtgcaagaaaccagtttgtggatgcattggaaattgcagagcctgcaagacttaaaccgatacagatgataaccggtccggttacaacaggcggaagataacgcatcacacgtttgactcccacgatacggataatcagtgcaaatatcagatagaaaagacctgctactacaactcccccgcaggcataagctgctttttcatttgctcccatagatgcatacattccactgtttaagtttgccactgtggaaaatcctcccaaaaatgcgaaggatgaacccaaaaatgcaggcactttgaatttggaacacacatggaacaacaatgtaccaaatcctgcaccaaataaggttacggaaacagtcagaccggttgtaagcggttccccacacgcctgaacaaaatagctgttgaccagaatcggtactaaaattgttgcaccaaacatggcgaacatgtgctgtaagcctaaaatcagcattttaggcacgccaagttttctggcgtcacgaattgcttctcctctttctcccattttttctctcctctttcgtttttttatctttcatgtgctctcggaatttttttgagagtacatcttccccattatagaggagagagtcctgttatggcaagcaaaatcagagaatcctttcaaaaatcatacaagtttataatgcaaaaaactctttaatctgtcccacaataatctgcatcagtctggttctcgcttccacacttgcccatgcaatatgcggagtaatgataagcttcctgctgtcttttatttttaccaatggattcgtttcactcatcggttcttcacataacacatcaagacctgctgccgcaatttccccggtctccagagcttcacacaaatcctgttctaccacaatcggtccacgtcctaaatttaagaaaatcgctgtctttttcatttttgcaaatgcttctttattcatcaaatcttttgtatattcatttaacggagcatgaacagaaacaatatcggatttggaaagcagagtatcaaaatctacctgttcatatccttcctgtgcgcttcttccggaagccgaataataaaccacatgtgcaccaaatgctttcgcaatatcagcaacccgtcttccgatcgttccaagcccgataattccccaggtttttccgctgatttcattaaaatgctctgcaaaatgcgtaaaaatcgtatcattgacatatttttccgttttgacatactcatcataataacgcaatttttctaataaatagaataacagcgcaaaagtatgctgagtaacagactctgtcgaatatccggctacatttctccatgcaattccacgtttttcaagatattccttatccagattgtttgttccggtagctgttacgcagactaactttaaattttttgctgttccaatcgtctgctcattaatctcaatcttattaattactaacacatctgcatcttttacacgctccggcacttcctctgatgtggaaaatccatatttcaccacttctccaagcgcatcataggctgataaatcaatgtcatctcctattgtctttgcatccagaaatacaattttcatgatccatctctcccttaattaaatttctttactcatttcatcataagtgcaaaagttatatcctaatctctgatatagcgcaaccgcacctgcattttctttttctacttccagacggaatcgtactgcatctgtatagatttcttctactgcctcaaaaaattttcttccgattccgtgtcctctatactccggtttcatatacaaatcttccaaccagatacacactccgccaaattcggttgaatatccggtcgctgcaattccatatccggcaatttcaccttcgatttcaaacacatatccatccacgtatgggcagtctccaacgcaatctgaaatatctttctgtaatgtttcgtcatccgctttatgaatgaccacatccgatgcataaaagatctgcatcatttctaaaacctctgctctgtctttctcctgcatggaacgaattataacctctccctttttcatttctaccttcattgttagtatcctttccttatgaaatcatgttctcctatcaccggaagctttttcacatccatatttgtaatcaaaatatacgtctgtgaattcaaatactgaatgagttggtcaatttgctcttctaaaccttgcacttcggcttcgaccgtcccatcgtatttgttttttacccagccggttaatccaagctgccttgctttatgtacgcaataatatcgaaatcccacgccttgtacatgcccataaaaaataatatgtctgcgaatcatccatacactcctacatctttaaaatagtaaaaacatttttggtataaatactatatccgttacgttcagaattttctccctcaagtgtttcgttgctactatcatagggtgagtaagagacttttgtcaagtctaagaacgtaagtcaaaaaaagctcccaataagctgaaatttcatgcctgttgagaacttttttctaaaaatattttaagattattttaaaatttcaatatctgtctgtattacctgtggttctttttttaataaatattctccatttcgtacagaagccagaattccggctcgttcgcatactgcatcaaactctgatttcgcttcaagtacaataaagtttgccggtttgccctcttctaaaccatattcgtcctgaatatgcatggtttttgctccatttacagtaattaaatccagtgcattgtcgatttcttcaaatgacatcatctggcaaatatgaattccgtgatccagaatcatcatcatgtttccatttccaagaggataccatgggtctgacatcgaatcctgggcaaagcagacattaatctttgcatcattcaattcttttactctggttaaccctcttcgttttggataggtgtcctgacgtccctgaagataaatattttctgtcggacaggagataaaattaatttctgctttcttcaataatttcatcaaacgaaaggcatagctgttatttgcagaaccaaaagaacaggtatggctggctgttgttttacttccgattccttccattgctacaaccagctcggtctttatcagctgttttccgatttaaaccagactcctttatacgaatctttcatggaaaatcaactgggtgtactcatccgctatgacgcagataaccacacccagttagttgaaacgttatctctttatttacaaaataattgtaatattctgcataccgcagatgctgcctatacccatagaaataccattaaataccgcattacaagaattgaagaactgttacgtgttgatttacaggatgcttctgttcgtctgaacctgcatcttgccctttatctgcatcagttcatcttaactacatgatttacgcatgccagatatcgttattatattctgcaattgtacggtcagatgaaaaatatcctgcctttgcgatatttacaatcatcttctttgcccatgcttttctatcttcataagcttttaaggcttcttctttctttttagtataagccttgaaatccaagagtgtcataaaccagtctttatttaacagttcattctgaagtctggttaagttttcttcatgaccgattgcaagcagttctttagaagtaataaagtctaccgcttctttgattgtctcatctttttcgtagaagtctctggaaacgtagtctgcattttcatagtgtttgattacttcttcgctggaagctccaaatacaaagatattatcatcacctaccagttcatggatttctacgtttgcgccatcttctgtaccgagagtcagcgcaccatttaacatgaacttcatgtttcctgttccacttgcctctttagaagccagagaaatctgttctgaaatatcacatgccggaatcagtttttctgcttttgtgacattgtagttttcaatcataacaacctttaagtatggactcacttcagggtcattgttgattaattcctgtaaacataaaatcaagtgaatgatatcttttgcaatcacataagccggtgctgcctttgctccaaaaataactgtgattggagtagatggtttcttacccgccttgatttctttatatttatgaatcacatataatgcgttcatctgctgacgtttgtactcatgcagacgtttaatctgaatatcaaaaatagattccggattcaattctacattttgagtctgttttaagtaatcgcaaagtgcttttttgttatctgcttttatatttaataatttttcaatggctgcatcgtcgtctttataagccaggagtttttccagttcctctgcattttctctgtatccggttccgattaattcatcaagcagagcggtcaattccggattgcagtgaatcagccatctgcggaatgtaattccatttgtcttattattgaatttttccggataaatcttataaaatgcatttagctctgtatcttttaagatttctgtatgcagagacgctacaccatttacactgaaaccgtaatgaatatcaatgtgtgccatgtgtaccacatcatttttatcaatgattacaacactttcatcatcaaattttcttcttactttatcatctaaaatttcgataatcggaaccaactgaggaacaactttctttaaatattccatcggccatttttcaagtgcttctgcaagaatggtatggtttgtgtaagcacaggttttggttacaatctcaattgcttcatccatctggattccacgtgcaaccaacaaacgaattaattccggaatgaccatagtcggatgagtatcattaatctggataaccgcatattcatacagatcatgcagatttgaaccacgtgccacacattcatccaggattaactgtgcaccattacttaccatgaaatactgctgataaatacgcagcagacgacctgcatcatcactgtcatccgggtataagaacagtgtaaggttcttttcgatttcttctttatcaaaatcaattccttcttttacaatgctgtcatctacagattctaagtcaaataagtgaagtttattgctctgattgttgtatccggttacttcaatatcatacattctggaatttacagtcagatttccaaaagttacaggataactcacctctgtttttgtcagccagctctctttttcaatccatgggtttggaactgcattttgtaattcatctttaaattcctgtttgaataatccaagatgatagtttaatccaactccatctccgcttaatcctaatgttgcaatagaatcaaggaagcaggcagccagacgtcccagtccgccatttccaagagatggttccggttcaatttcttcgatttcgcaaatatcttttccattttctgcaagcatttttttcacatcatcataaataccaaggttaatcatgttgttggataataatttaccaattaaaaattctgctgaaatataatagatttttttcttctttaccggtacttctttgtccttcgccatgttctgaacaacatgtaacaatgcataatacacttctgcattagatgcttctttgattgtttttccaagttttgtttctaataattcctgaattttcatcataaaaaaatcctccatcattctctttctttatcttgctctaaattctattttcctgttatcctgtcgtgtttcttatctgcattttactatgctttttcaattatttcttgcaaaatactctctatttataatacaatactatcaaaatataatttacaaattttgtataaaaatggaggaatttgttcatgaacctcacagaataccaaaattaccatgagtcaaaatctcatacttctctcgaatttccttataatacttacctttgctgtatccctatggactttacgcatgttcccattcactggcacaatgaaatggaattaattgtcatccagaaaggcagtggaatcatctccgtagactttattacccatgaagtaaaagccggagatattgtctttgtgcttcccggacaactccattccatcaggcaaaaaaaagaagcacggatggaatatgagaacattctctttcatccatctatgcttctttgtggtgaaccggatttgtgcggaacaaatttcattcttcctcttatggaaaatcctgctaccattcagacctttctcactccagatgcccctgcttatgaatctctttccggatgcatccgaaaaatcgataatctctgcgattccagaccaaaaggctatcagcttgcagtcaaaggctggctcttccagcttatgttttatcttgtgtccaatcagcagacactaaaacagccttctcagtctcaccaaaaacatatggataaactaaaaaccattttaaaatatgtcgaagaacattacaacgagcctttaaacattgaagatatggcaaatctcattcattacagcaaatctcatttcatgaaattttttaaaacacatatgaatatgggattcacccagtatctcaatcattatcgaatgagcatggcggcaaaacttttagtttcgaccgatgattctgttttgacgattgcagtctcttccggctttgataatctttcgtattttaatcgactctttaaaagagaatttcatatgacgccacgagaataccgtcgtcagcaatgatacgtttgacacttacatgattcttttcaaaaaaaccttattgagcttccgtttttttaactcaataaggtttttgttctatcttgattctatttttattctatttttactttatttgcttttcactgctcctgcaattttctctacaactacacaaagcacaactgtaatcaccatatccggtaatgtatttcccaccggtgtatctacctgcatcagcagacgataaatcacaaaaccaacaagccaaacagccagatttctccactgaaatgcagatttttgggcatctgccttttttaacataaagtaatctgcaatttgcactgcaatcatcggtgcaaacacagaaccaatcagatataagaaatttgtaatgttatccattggatacacaattgcggcaatcgttccaattaccgtaacgacaattgccgcccatttttcctggattttagaggaaatcgatacactcgaaactcctgcggaataagcatccaaaaaggtagttgtaactgtagaaaatacaataattaaaagtcccacaataccaaaacctgtttttaacataatctgcgcaatgtcatattcaccggtaaaaatagctgctcccataccaatcatatacataaaaatgctgaccagactgtaaacaactacacttgcaaatgtcgctgcaaatggtttttctgcttctcttgtatagtcactgatcagtggcagccaggaaagcggcattgctaccgcaagctctactgcggctccaaatgtcagacttccatcatctacaattgccggcatgcttccatttccaaaaaagataactttaaaaagtaccaacgataagataaaaagtgcagtcattgcaacggtgtttaatttaccaagatttgtaatcccaatcagaatccatacaataatcagaacaccgataataatcgcccaaatccaaatgccggtatgtagcacaccatctgctgcaagtgcaccgtcataaatcataattgcagtccaacccacaagctgtaagacatttaagatggcaaataaaaggcttcccctttcaccaaaactcatttttactgtttccatggcacttttacgttcttttgcaccaatcattcccgctgcaaacatcataagtccgccaatcagatgtcccagtaaaatcgctgccattgcttttccaaagccaagtggtgcaaaataagtaccggtcaggatttcagctaaagatacccctgcaccaaaccaaatcagtccgtttgaaaaaacggaagttctcttttcactcatccctcgtactctcctttgactgcaaatgcatggttcatcggtccgcttccttttccaaggtcaagcatagcggcaagcgcgccggaaatataattttttgcatattttacggaagtttccaaatctcttccttttgcaagatttgacgcaatcgctgaagaaagagtgcagccggttccgtgtgtattggaattatcaattctctttccatggaaccataccggcgcttttcctttttgaaaaagcaggtcgttcgcatcatttaactgatgtccgccttttaataaaactgcacagtcgaatttctcacaaataagctctgctgctttttccatatctgcttctgatttaatttccatctcagaaagaacttctgcttccggaatatttggagtaatcactgttgcaagcggtaatagtttacttttcaatacactgatagcatcttcactaatcagtcttgccccactggttgccaccataacagggtctactacgatattttttgcgtgatactcagtcagtttttctgcaatggtttcaatcagctcacttgaagaaaccattcctgtcttaatcgcatccggataaatatctgtaaaaatactatcaagctgctctgccaaaaattttggtgttacctccataatatctgttacgccagttgtattctgagcagtcaacgccgtaatcgcactcatcgcatacacgcgatttgcggtcattgtcttaatatctgcctgaatgccggcgcctccactggaatcacttccagcaattgttaatgctgtgtacatcattttttcctccttgttctttgcattaattttatagagcgacaaaaggtggtgcccccaatctgccgctgttatgctttgaatctttcaacgtattttaaaaatgcaggaacccaacgaaagattcctgcatctaaaacacatatctgtgattcattatctccctacgttggcattacccaaatcaggttccgggttaaagcatccgcttactctcagcctgcttacgcaagcaccccgctttttataacaattttattatacacccttatcttgaaaatacaagtttttgatgctatttttaccttgaacccaaatagcaggtgcaactgatatgataatctgtcgcacctgccatcttccttcatcgttcttacgatcgaggtaaagccttttccactccaataatttgttatatgcttttcttcaagatttcaatctcgcattttatgactttcttcaagattttattttacgtttttatgactttcttcaaaattttatttttctaccggctcatccatcttgcccaggctgccagccctgctccatgttttatttcacctgatgccaccattcttttaaattcttctatcgagacttcatgaagtttcagcacctctgccgggttcaaaaattcctccccctgttttccacaacaaattgcaaaaagatggattttctcattcgtcgaaccaaacgacggataaaaatctccaagcagaatcacctcttctgcttcatatcccgtttcttctttcaattcacgtactgctgcctgctctgctgtttcccccgggtctatcagtcctcccggaagctccgtctgccacaagcggattggataacgatattccttcagcgtaataatattttctccatgaaacggaagaatacttactccttcaatcatttcaagataatcataaggtcagatctgatttttcacccgtactttatcctgtacaagtgtaaagcgacccagctttattttctctgactctactgtttcaaatggactttttatttccttcatatttcttccccatttgtcttaatgacatgtttataccaatacgccgaatcctttagaattctctgctgattacgataatccacatacacaagtccaaatcggtcagaataaccttttgcccattcaaagttatccatcaatgaccactggaaatatcctctgatatccacctctgttgcagctctttttagttcatgcagatatcttccaagaaaatcaattcgattcggatcatgcacttttccatccagtgaaatcacgtcatggcaagataaaccattttctgtgatataaattggtttttgatatctttcatataaaaattttggtccccaatataaacattccggagtaaccggccactgtatcgctgttttcggaaaaccttcatatctttgaacggcctccggctttccattctctcccatacgataagcgcagccattatagatattttgtccatagacatcaattggttcagaaattaatttcatgtctgcatctgtaattttcggaagatatttttcataacgaaccaagccttcttccggataatgtccaagcagtaccgggtcagaccaccacgctacattccaggtccagttactgtcatcttcctgcatggaaaagtacatctgtcttgcggcttcaatatcttccggacggttagtctcaggatagcagacagaagaagtcggagcatatccaatcgtcagcttttgttttccataagcgcgaagcatctgcactgcacgcccatgtgcttttaatgcattatgtgccatctcaaacgtatctcttaacggtgcttttacacccggcgcatgctctcctgtaagaaagccaagtcctacgaaacactgtggttcatttaaggtaaagaaatgtgttactcgatcagtaaaacgctctgcgacaagctttgcatattctccaaaccactccacaatttgcggattcatccaacctcctcttttataaatctcataaggaagttcccaatgatacagcgtaatataaggttctatctcattttccagcaactcatcaatcagtgcattataaaatgcgattgctttttcattcactctgccatatccttccggaagtacacgtgaccaatcaattgaaaagcgatacgcttttaaaccgattgctttcattagctgtacatcttctttgtatctgtgataatggtcacatgcaacctctcctgtatgtccggagtagatctttcctggttcttttgtatatacatcccagatgtgttccccttttccatcttctgtcacggcaccttcaatctggtaagcacttgttgcagcgccccagacaaagttttctggaaatttaacttctgtttttgccattattttcactcctgttcttgttttaatcttaaagcaaacttgcagctccaatcattccggcatcatttccaagtgctgcgcagtctgcaacatgtggacaactgcttttatcttttataatcggaacacggttggttacagcaagtgctttttcaatgtgtaaatctcgtttttttccatcttttcccactctgccgtaatcatacacacgataagtcacattcgaattttgctgaatttcagcaatcaaaatgcctgcgccaatcgcatgaatggttccggattcaataaaaagcacatctcctttttgtaccggaactgcatttaatacttcaagtaatgtgtcttcttcgattcgttttgcaaactcctctttactgatttctgttttaaaaccataatacaaataggcacccggatccgcatccatgacataccacatttctgtttttccgtactggccttcatttttcaacgcataacgattacttggatgcacctgtacggaaagactttgttttgcatcaataaattttgtcaagattgggaaatcacgaaatcttcgacagttgagtccaagcacttctttgcctttgatgtcgatatattcctgcagtgttttccctgcatacattccatttgcaatataagatggcccgtccgaatgacaggaaagctcccaggcttctgcaagtacctttccatcatattttacaccatactcttctgccagtctatgaccgccccacagataatctttacagcttggtttcaattttaaaatactcatcttttatccgcctctatcatttctcacttaaaaaatcaatatatttctgacacatttctttatgggttccggtcgccggaaaaacaagcacaaggtcttctttctctgttccatcaagctcactttccagttttgtaccagttaaatcaattgcttttgttccttcagcttcacagagattcaagtcttttatctcaaattcatcggcagagtaatactctccgccaacactggtgcagtatttcagaaagtcttttgtcagaatcactgcatctaattctcccttagaccactggaagaaaaatttatcaaatccgctttcatttcctgcatcctgtttttcttcagcttccttataagaaatcacatagtctgaatcaaatacgattctttttgcatcaagacctgaaaatgtggcaaattcttctgataaaactacatccctgtctgaatcaattttctgattcaccaaggcacatttaaaaaacggtttttcttctggaaatgcaaaatggacaaccaggaaaatcaagagagcaaggactgcaagaatgcctaacatatggtaccaaataacattttgttaacacttaattaatttaatcccgattttttagtagtatttgccatattcttgcatattttaacttaatttaagattaataattgaattaaattatttttttttagtaaaaaagaccagtgagtgcatattctcaccagtcttttaagttctttaattaatttactatttaagttttacacttttcttaatcaccatgtggccagatacaatgtccattccatgtccacgttttggatttttaatctgtttcagcactttttctaatgctacttttgtcattgcttttgtatttacttcataagttgtaatctctctatccgcaagtcctggatagagataattatcgaatccaacaacagaaatatcttccggaactttatatcctctttcattcagcttatcaatcagcatatacgctgcaaggtcacagctacagacaaagcctttcggcagtctctttggaagtttaaatcccatctgtcccagttcacccctgtcctcaatgagccactgtggttttatctcttttttgtggctcatcattgcttttaagaatccgcagtatcgatccataatactgcttgttgaataaatcgagccaacaaagccaagttcttcaatttcctgttcaaacatgaattctgtcaacagatatgttccataaaaattatcggtaacgactgcatcctttgcaaagtctttatcataataatccagaaataccaccggaatccttgctgtttctgtcagctttacaatgtattctttattaatttttccaagaacaatcagtccgtccactttatttccttccacacatgccggaagttttaaagtatttctttcatcttcttttcttaaaatttcaactgctgcaaaacagcgtttttctgttgcagctaccgcaagttcctgatacattttccaataaaatgtttcgtactgtgcaagataattttctgcaataagcacaccaactgtataacttgcttctcctgctgcctctcttgctttctgttttcgttctgacaaaatctgatagcccatctcacttgccacactttgaatcttttcacgcagttcttcactgacacctttatttccggcaagcgcattatgaaccgtaaccgtgctgacacccacttttttcgcaatgtctgccagcctgacttttcccatctttttcacctcatctattcttttaatctttttcatctacttaaatttaagttaattataaagggattgggcttaagctgtcaatggacaaaaaaagaagacgagcctcgatgatttcgaccacctgtactcgtcttttttatattcttatatttttatatttttaaattactccatacttacccgctcaatatgcatcgcaagatatccaatctcaatctcttcaagttgaacccgaagtgccttactcaaatggtcacagacaattcttgcaagttcataagactgtggaaaattgtgctccacataatcattcatatttactttcagtgactctttatttaatgcccgtgctaccatgaattttatatggttcatcaaacggttataactcaaagacattacatcaatatgaatctttctctgtgcttcaatcagcgaaatgcattctcttaccgctcttgccatctgcatagaaaccgcaacggactctttttcaagcgctgaatgaatatgcagtgcgacatatccaatctcatcatcctgcacatcaattcctttttctttttttaagcgttcttttagtgccagcgcaactttaaattctccataaaataacgtcttaatatcctgggttaaaggatttgaaatctgttctcccttttgcattcgttttactgcaaactcgatgtggtctgccatcggaaacaaaatactctgatcaattgttccaaactgttctcttgccagattcaatatctgatttgccatttccagatattcaggctctatgcttcttgccagttcagaggctgctcctcttgatgaagtttcctgcaacgaataaacggtacactcttctggttgttccattcgttcgcctactttttttccgaacccgactccttttccgagcaacacatattctttattatccttcatatcaagcgcaatcaccccattatgatttaaaactttgcaaatacgatacaccgttctcccaccttttcccaggattcccccgtttttttctaaagcctttttgaccccaactttctatctctactttagcatatttcctgtcattttcccactgaaatttcagttttttgagaactcacaaattctttttctcagtttcaaaatcatacccggagcaacagagagttcatccactcccatcttcataaattcatcggtaagttccaaatctgcacctaactctccacagattccagcccattttccatatttatgagcgttttccactaccattcgaatcatcataaggattgccttatgatgcgcattatagaaatcatccagtttctcgttctgacggtcaatcgccagcgtatactgagtcaaatcattcgtaccaatactgaagaagtctaccatctgtgccaggtcttcactaatcataacagccgccggggtttcaatcattactccctgttccggtactttatacggaatttctgcggcatccagttcctgttttacttcttccacaatcgcaaaaatctgctctacttcttctgtagaagtaatcattggatacataacagacagattgccataaactgccgcacgcagcagtgcacgaagctgggtcttgaaaatctccggctgttttaaacagatacggatcgcacgatatccaagtgccggattttcttcttttccaagattaaaataatctacctgtttatctgccccaatatcaagggtacggataatgaccttttttcctgccatcagctgcaatgcctgcttataggcattaaactgttcttcttctgttggaaaatctgtttttccaagatataagaactcgcttctgaataaaccgattccttcggcgtcattttccagtacaccggcaatgtcgcctacactgcctatatttgcataaagatgcactttcttgccgtctgctgttacggtttcttttccttttaattcctgcagcagttttaatttttctgcttcttcacgcatttttgcttctgtttgttgttttacttcttctccgggttcaacaacaaactttccttcaaatccatctacaacggcttccattccggttctcaactcttctaaatcaaccggaacaccaatcaatgccggaatattcatcattcttgcaagaattgccgtatgggaattcgtagaaccatgaacggtcacaaatccaagaattttttctttatccatctgcacagtctcacttggagaaaggtcatctgcaacaatgatggatggctccatttcacttaaatcaacagaaacatctcctcttaagttttgaaccagacgatttgaaatatcttttacatctgctgatcttgcctgcatgtattcatcatccatacttgcaaaaatctcagcaaaattatcaccggtcactgcaaccgcatactctgcgtttaccagttctgtctgaatcatattctgaattgcatcctgataatcttcgtcttccaacatcatctgatgcacttcaaaaattgctgcgcttgcttctccgacttcttttaccgctttatcatataaatgctgtaactgtgcctgtgaatctgcaactgcctgttttacccgttctatttcctgcttagcatcctcgattttttcacgttttacctgaacatcattcttttttaataccgcaatcggtccgattgtcagacctctatacacggactttcctctatattcacgttccattttcatttcctctcttaaaaacggtcagataaaaatctgaccgccattttttataaattttcttcgaaaaatgctttcattccttcaaatgctgcctcttcgtcagcaccatcaatttctactcgaacatcctgtccgcattttacacaaagtcccataactgccatcagtcttgtcacatccactgttttttcccctttgctgattgtaatggaactttcatatttttttgcctcttttgcaagaatacttgccggtcttgcgtgaattccctgttcatctttaattgtgtaagtaaattctttcatgataatttctccttttattttttattttcttatttttttatgcttcataaatatcaattgcatataacggtgctcccgctttgatttctccgcttgcaagcagtctgactttctgattatcctctaactctgtacacagaatcggagaacataaagaaggtgcattggctttaagatactccagatcaagttccagcaatttatcacctttcttcactttctgtccgttttctacaaagcaggtaaatccttttccatccagttttacggtatcaattccgatatgcagtaacatggaaagtccgctgtcactcataaatccaattgcatgctttgtatcaaaaacaaaagcaatttccccatcttccggagcaacaactacaggatttgtaggtgttaccaccgctccgtctcccatcatttttcctgcgaatgcatcatccggcgcatttgccagatcatctgcaattccggtaatcgggctggaaacgataatcgtttcttttacttttccagtctgtttttcttctgttttctcttctgtttttgaatcggctgtttcttccattgtatgaagttcttcatccggagctgtttccagataatcttcaaagtttgatttaattacagtaacttttggtccgtagataatctgcacaccatttcctttatgcaccacaccggatgctcccgttgcttttaaaattgtatcatttaccagctctgatttatgcacggtacaacgaagtctggttgcacaacaatctacgtctgaaatatttttcttaccaccaagacctcttaagattccttcagaaacctggtcctctgcagatgcacttttttctccttcttttctggcattaacatctgctcttgtgtaaagttttacttcttctacatcatctctacccggagtttttaaatctaattttttaatcaggaaactaaacagcacatagtaaacaataaagtataccactccgacaactacaatccaaatccaatttgtctttttatttccctgtaaaataccaaataagaataaatcaataaatccaccggagaatgtcattcctactccgacttttaagatatgcatcagcatataagcaagtccggcaaatacacagtgaactccgtataataatggtgctacgaacaagaatgtaaattcaagtggctctgtaatacctgtcagcatagaagttaaggctgcagataaaagcagaccttctaccgcttttctttttttcggttttgcagtacgatacatggcaaatgcagctcccggaagaccaaaaatcataagtgggaacttacctgacataaatcttgtagcagataccgcaaaatgttctacactcggatcagataactgtgcaaagaagatattctgagcaccttctatcatctgtccgcctacttctaaggtaccaccaactgctgtctgccagaatggaagataaaatacgtgatgaagaccaaacggaattaagagacgttccataaatccatagacccaggtaccggcataaccggaacgaagtactaaatctccaactgcataaattccggcctgaatggtcggccatacgaaaaacattgcaataccaaccactacatagacaagccctgaaataatcggtacaaatctggttcctccaaagaaggataatacctgaggcagctcaattttataaaagcgattgtgaagcgctgcaacaccaagtccgacaacaatacctccaaatacacccatctgtaaggaagtgattccacatacatctgtagttgcaccggaaagcatagcttctgctccgccgttaatatcaattaatgctccaatagatgcatgcatgatgaaaaatgcgattaccgctgaaagtgcggcaacttctttttctttctttgccattccgattgcaactcccattgcaaatataatcggaagattcgtaaaaataatatttcctgcggcattcataatctgtaaaacctgattgattatggtgccaggtcccattacatttaataagccatatgcttttaacatggtctcatttgtaaaagaaccaccaagtcccagtaacagaccggctaccggaaggattgcgattggaagcataaaagaacgtccaactctctgcaaaattccaaaaatcttgtctttcatgattttctcctcttttcttttttttagtatatccgtttttgagttcttatataggcaagtcttttttagccggctgttttccacaaaatttttttatggaataaaaaaggcactaaccctacacaaatatctcaaaaaaaatatttatgcacagttaatgcctgcttactcagtaacacactatgactgagattacttataccataatttaaggttgaagtcaatcatttttgcaaaaaaatcatctttaattagcaactggaaaattcaatacaactcgataattccacaatatcatcaataccgcactttagaacattgcatatacgttctaagttttcaagaacattttaccaacaaatttatttaatccgtttctggatatcctcaacagatggtaattgcttttccaaatcatccggcagattactggttattttgtattcgctcacacctatcggttttgaaacatccttaagtgaatattctgcaaccacattattcttacttttacacagaagcaaaccaatagacggattgtcctgttcttttttcaaaataccgtctacggctgacaaataaaagtttagctgaccaacatattccggtttaaagtcaccggttttcaattcgataaccacataacagcgaagattcaggttataaaacaacaaatcaatataaaaatcatcaccgcccacattcaagtgatactgatttcctaaaaatgcaaatcctgttccaagttccagaagaagttttgttacatcccgaaccaatgcctgctcaatatctcgttctagcatatcttccttaaaaggaatgaaatcaaaaacataagggtctttcattgtctgcatcgcaagttcactctgcggagatggtaaacgacgttcaaaatttgtaatcttgtctgccagaacctgacgttgatacaatctactttcaatctgatggacaagaacatttcgtgaccagccgttttctgctgacttttgaatataccatttgcgttcatctatatcagcaaccttatccataagaacaatattgtgaccccacggaatttgtgcaacaacctgttgcacaaattctcgttccgaataagtctcagcgaattttgccatatactttaagttacgaacagaatagcctttgctttttggaaacgctattcgaatatctgctgcaagattatcaataaatttgtttccccacaatttatgttcattaatcacacaaccaatatcataatacagtagtaacatgtctgtattcacatgaactgccgcacgatattgtgtcgcagtaatttcactcttaatattttcaataacagaaagatactcctgcgtattcattagcacacacatcgcctcactttcacatcatttttatcattatttttttctcttaatatgctaatatgctcttctaaaaagacaatcgcactcttgttatctgctgctgatattatcttaacttacctactaaaacttatcaatccaaatttatattttctctttttttacctcaattcacaattcgataatactctttcgcagtcaccccatacacaatcgcatagaataccgcaaacaccaccacactcacagccgtacattctgcaaacagcgtttcatttgccagattcagcaccgccagcagtttagtcataacaggaaatgcaactgccacatgcaagattgcaacgccaagtggcaagaagaacacgcttaacacctgactatgaattgcttttttgacttctcgtttactcattcctactttttgcataatcttaaagcgttctttatcgtcatagccttctgaaatctgtttataataaataatcaacaccgttgcaatcacaaacatcattccaagatagattccaataaagaagaatgaaccatacaaactatagaaagacttttcacttaaaatccggctttcaaaattaatgttggtattttctccgaattttatctgcattgcttctaaggcttgtttgcaggattttttatcaccttttaaatcaaatccaatcgaataagaaacatctgtcatcgcttttgcagattcttcttcctgtccattttttaatgccagttcttttgtcgcttcggaaaactggcgtatctgttccaactttggaagaatcacataaaatgttccataagtaccggctttatttttgggttctgctttcagcgtttttaattctttctggatttgataagttgttccatttatcgtaatctgagatgcaccataagttctatctgtgcaatataataatgcctcatcttcatttaaagaaacattctggtgttccatctgattatattcatccaccggaattaaagtcatcccacaaattccaaaaacggaaaaatcagatgccggtcttaaggtaaaggaagttccttttgattctgccataagaactgccccatgataggtaatctcagaagtttctgtcacacctgctttttctgcttcatcctttattatctgtcttacctgttgttccgtctcttcatttgttgaaagaatctcaacctttgccggacttggaaatcttacggaaagaatatcattcattcccatatataaggatactgtcatggaaattagtacaagcaccatcgtacttaaaatacagatatttgcaagtccgactgcgttttgtttcattcgataaatcattcccgaaactgccgtaaaatgatttgccttgtaataatatctcttatttctgcgaagcaatttcaaaaatgcaatgcttcctgcggtaaacagcgcatacgttccaataatgacaagaattgccgctacaaaaaacactccaagtgccgcaagcgggtcttttgtggtaagcgccagataatatcctgccgagagggttgccactccaaacagtgccatcagccattttgtctttggttctcgttctcctgcatttcctccatgaagaagttccaccggattagacagacgaatctgaatgatattatagaaataagtcagtaaaaagattgcaccaaataccacaagagtatccactaatgccggctttgaaaatgcaatgtttaagcttgcatttcgatgcagaatttttaaaaacagcagatacatcaagcgattaaacagactgcccagtccaattccacctaaaatactgataccgccaatcaacagactttcaattcccatcatttttgcaatgtgaaattttcccattccaagaatgttatagacaccgatttctttttttcttcgcttaattaaaaagctgtttgtataaaataaaaagataacggagaaaatcaccataattccggctgcatactgaaggcagacctgcatcgttccttctcctgcgatttcttttattctgcccaaagtatcaatcataaaaaacatcataatacttaaaatcgcagttagcatatagggcacgtaagttctacgattattttttaagttcgttactgccagacgaagatagagtctcaatgtatttcaccccctgttgtaagtaccgtaagcgttgccgaaatcttatggtacatctcttcatttgtcatatttccacgatacagctgatgaaagacttcaccatctttgataaataacactcgacttgcactgctcgctgctttcacgctgtgcgttaccatgacgatcgtctgaccatccatgttaattgtatgaaataaatgcatcaggctgtctgctgccttagaatccaatgctcccgagggttcatccgctaaaatcaactgcggttttgtgattaacgcacgtgcaatcgcagctctctgtttctgtccgccagatacttcatagggatatttttccaacaacattgtaattccaagtttctctgctatcgtagcaagccgtctttccatttcctgatacttctttccggaaagcaccagtggaagaaaaatattatctttcaaagaaaacgtatctaacaaattaaaatcctgaaaaacaaagcccagattttctctgcgaaaagctgagatttctttctcacgaagccctcccaaatcacttccttttaaataaacctttccctgcgtcggcttatccagtgccgctaaaatatttaacagcgtcgtttttccagaaccggactctcccataattgctacatattctccctcttccacagaaaacgttacattttttagtgcttctacctgattctttccaaatcgggtggtatatattttcttcacattctttacatccagtaatgccattttttctcatcctctcttgttttgttcgtctttatttctttaccttacaatgcttattataaaaaaagagaaaatgtattaccattgaatcaggttacattttctctttgaatcttacattgttgtaaggttaaaatttcactgtaaaactaaattttttattcttcataattttgtcatacacattaaaatagatcaatacttttttaatttgaccatacatcaccaaattagtataataaatttatagaaaataaacatccaaaagggggatttttatgaaaaatcgcatcgttttacttactctatgctgtgtatctttattatgtattggataccctctatctaagaaaatttcttctccttcaaaatataaaacggttcaagtatctgaaaccgacaacacaaaaacttccgctgtcaaccatacacaggaggatacaccaaaaagctccgtatcgaaagacaaaaatacttctgagtccacgacagcgccagaatccactgattctattgattcttcagaaaccaataataccgtaaacaataatgattccactgctccttccgctgcagaatcattgaataattccggcaatattgccaatacagaaacttacgataactccaatataacattagaatcagagcaggaaaatcagccagtcaatattgaaactgccgacgatacaacccaaaccgaccccgttgaagaaaaccaaaataatccacttcaaacagtacaggcttatgttttatccgtagatggcactacgatgtatgtagatttagaaaatccaggagcaagaacttatcctggagagggcgaagaacgccaaactgcttttgatatttcaaatgcagaacaaattcaaacagaaatcagtgacgtttatcctgcaagcaatcattttatttgttcctgtgtttctgttgaaatcgaatattatacagaaaatggagttaatattgcgaccaaattgacctctaacggtcaggaaattgcaccactttactttaaagaataacagtcattagaatctctaaaacctaaaaagagacaaatgcagtggctttttcatcagcccctgtacttgtctcttttctctctcactgaaaattcctctgtgatatatctttatttcttatttttctattccggatgcagttcttctcttgccagtcccaaaaacacctgtgttcccacacccactttggattctatccgaatctgatgccgtaaccgtcccatcactttcttacaaagatacagcccgattccggtagattttttatctgccctgccgttatatccggtaaagccccgctcaaacactcgtggcaaatcttcttcccagattccaattccattatcctcaatcacaagccataactgattggattcctgttttgtaaaaatttgaatcgttccacctttttcagtgtattttaatgcattggataaaatctgttcgattacgaaacacagccattttttatctgtaatcacattctgattcaccgcctgatattctaaccgaatcttttttaagataaacatctgggaatatttgcgaatacttgcccgaattaaatcatcaagcggataatgctcaaatttcaaatccgaagccatatcttccattctaagatacgtcagcaccatttccacatactgttcaatccgaaacaattccgcttttaattcccgtagttttttctcttctggatactcctcttccatcgtttgtaacagcatccgcattgcagatattggtgtcttaatctggtgcacccacatcccataataatcctgcatttcctgtctgaaaatcaattcttcggattttaattttcttcggatttcttctaatttatcaagcaaatcctgataatcattttcaattaaagtatccggttccggcaaatccagaagcgcatcctgcatatttttctctactaaaacaagctctttatgcctcttataaaactcgcaaaaatcaatgaaaaataaaattccagccagtacaagaaccagcaaaaaaccataattcaacgcatcagatggaagattatagaggaaaaatacaaatttcaaaagtgccagcgttattatataaagcaaaatttcccttgcccgctcttttaaaaatcctgcaaatattctcattttgccaccatatatccgattccttttttggtctgaatcacttcttttagaccaatttgttccagttttttacgaagccttgtcatattgacggtcaatgtattatcatcgataaattcgtcactttcccaaagtcttgtaatcagtgcatcccttgatacaatcttcccggcatgttctaacagcatctgaaacagacgaaattcattttttgttaattccattttattctgctcatactcaattgttgcatcagcaagatttaaatatgccccatgccattgcatcacatcgacactgccctgaaattcatacgtccgtctgagcactgcctgtacttttgccgtcaccacatttaaatcaaacggtttttcaataaattcatctccacccatgttcattgccattacaatattcatgctctcgttagccgaagaaatgaacagaaccggcaccttcgatacttttctgatttcctgacaccagtgaaatccattgaaaaatggaagaaccaaatctaacagtacaagctgtggctcaaattttaaaaacgtatccatcacatttttaaaatccgtcacaccctccacctgataatcccatttttcaaagtgtgtttttagcccatctgcaattacaacatcgtcttctacgattaatattttatacataatgtcctcatttattataattcaaacgcttccatatcatccggcacatagagatttccatgataataggcttttccttcttccgtataaagtgccttccttgctttgatatttttatcttcggtatgatataaaatcagattttccacccctaatttttctgccagctcacaggcatcttttacggtagagtgatttttttcatacggatggaaggtatctcgctgtccatacaggcaaaatgcttcatgaagcagccatttactttgtcttgcgtatttttcttcccaatcgcagtatggttcatctccacaacaggttaacttctgtccttcttctaattccatgctaaatccaaactgttttgctttagtagaatgaatatcaaaaaatgtcactttctttccaatgatttctttttcctctccatcggaaaccacaaccagatgtactctctttccaataaaatcggtctgttttttctggagcagtttttcagcaagttcctgaattaaagaaatcacttcttcatgtccgtaaatataagcatcaccttcataagcacctttctgcatattttggcagataatacgggtcatccatacaattcccaaaatatggtcgatatgtttatgagtcacaaaaatatgatgaatgtctgagatagaaatatccgcatcttttaagcgttttaaaatttcgcttccaccgcctccatcaactaataaatattgcttctcattttcaattacaaaacaggtattataaacttctgttactaatgcatttcctgttccaagcattgttaatttcatttttttcttcctttctgttttatctgtttaactttgttgttttaattcccgatgtaccttttttcttacaaaatagaagcaaactgcctgcatcaaaatcgtcaatgtccaagacgccggatacgacacaaataaaatctttaaggaacgatgagccgggaaaactccaaaaatccacacaattcttgttccaactgttccgataatcgataaaatcattggcactgccgaagctcccattcctcgaagcgcacccggaaataaatccatcactccacacaaaaagtatgtcaccgtagtcagtgctaaaatttccagaccacagcgaataacttccggatcttctgtataaatctttaagatttcaccaccaaatgcataggaaccacatcccagtacaagtgaaacacctacacttaaaataatacagtctatcattactcgatccattcgttttggcttatttacaccataattctgacttgtaaaactcatacacgcctgtgtcaccgcattgattgacgcatataaaaatcccagaatattatttgccgccgtatatccggccatcgctgttgaaccaaatgagtttacggaagactgcaaaagtgcattggaaaaattaatgaccgtactttgcacccctgcaggaattccaacctgaaaaatctgtttcagatactcttttttcattcttaattttgaaaaacgaagctgataacttccttctgttttataaaggcaccacagcactaaaacgcaagaaatcagctgtgaaatcactgtcgcaatcgcaacacctgccactcccatgtcgaatacaatgactaaaatcatgttaagaattgcattggtaacccctgaaataatcaaaaacatcaacggacgtttggtatctccaacagctcttaaaatagctgctccatagttataaagcatgaaaaatggcatacctaagaaatagattttcatatacagactcgactggtctatgacatccgccggtgtccccatcagttccagcgcccaccttgaaaaaagcagtccgactatcgccattgcaattccactaatcaacgccaacaatatcgaagtatgtactgtttctgacatttctttttgtcgccctgaggcataaaaacgtgcagccaacacatttgccccaagtgatactccaataaataaattcgtaaacacattaatcaatgccgtcgttgaaccgaccgccgcaagggcggaacttccactaaaccttcctaccacaacaatatccaccgcattgaacatcaactgtaaaattccggaaagcataagtggaagagaaaacgaaatcaatttgtccataatcgagccattgcacatatcaatttcatatttattttgtttcatttttatctccatctcccgtcttttttttacttctctttatcagtatactatacaaaaaattgcaatacaatggagaaaaaatcaaaaaatcaggtaggaaaattcctgcctgattctttgactacttattcaatttaatcacaatatctccgtcatctgcctgtaatttcagattgccatcttttccatttctttgataactgctttcatccacatcttcttcatgaagctttccttcaagaaaatccggtacctcaatatcgccaaaacctgtagatgcatcaaatccaagtgttaaaagctgttctttttttgcttcaatatcaatatctccaaagctgctggaaatggaattttcaccagtaaactcactatcttttgcgacgaaatcaccatcggaaagttcaaagttacaagcttttatcttagaatcatacgttttcacatcaccaaaagaagcggaaacggtgacatcttttaaagtactattcttaataaaaatctctccatcatctgatgaaatctttccactttcaaagcaactgctattaatcaggatatcaccaaatgaactgtttatatttgcagactgaaatcttgcatccgttggaacatataatgttacaacattttcatccgtcgtaaagtctttgtcttttgacaggaatgctgtaagaaatccaatatctatatgtgtataagaattggagtctgaatcttctttaagcgtaagaattttatttttcacatcataagaaaccggttctttttcctttgaatctgaagtcgtataactgatataatacgaatcatcatcagaagatacaatctgcaagtttaaagaagaaagatccacgtttaatgtgctataatcatctatctttgttttttctaatccataagttgaatcttcttttgttgccgaacctttccattggtttaaatcagcggcaagcacataattttttcctccgttcaaaaatccaactgcaaagagaagtgctcctgccacaacgcatcccgcacctgctgcaagacaatttttaatccatcttttcatgaatccttcctccttttctaaatctctttgaacgtcctgaaacccattttgccaatttcacgaataataatccaatcccttttgcaagcgcaacaccaagaataatgctaagtattccaagaccaaccacgaaaagtccgcttccacttatgattgcaaatcctggtacggaaaacggaattgctaaaattccccggataaatagttttgccccgactaaaaagaaacaaaatgcaaaaataaaaatacatagtactatgactccaagacaaattaccaatgataatacgactgcaaggaaagcaattgcaagcggtgcaccaatcggtgccgcacaaattgcaaggcaggctatccaaaagagactccatttcgatgactttttggttgtttcggattccgacacctgctcctctaacttcctatccagaagattagaaatcaagtctcttgctgcttcttttggagttccaagttcgttcattaactcctttgcgccctcttcgtctgtctcttcaaaatattctgtgaaatactccatcgcatcttcataatcctgcgaagaaagttttttcaaatatttttgtaactgttttaaatattcttctttactcaacttcgaatcctcccctctataattccgtcaattgtatcgcaataggcaatccactcatggctaagatattcgatttgctcttttccactttcggtaatcgaataatactttcgttttcttccctgaaactcctgtgaatacgtggtaagaaatcctgccttttcaagttttttcaaaatcggataaagcgttgattccttaatatccgccaccagtttaattgtctgactgatttcgtatccataagagtcctgagtttccacaattgtcagaatcagatattcaatcaataaagcagaaaccggaaaatacatgcaatcatctccttttttaatatgtaaaatatttatatatataaattttatatatagtatagtgccagaacatcgtattgtcaatatatatgtaaaaattttatatatatattctttcccaaacaaaaatacaggattccagctcactcatgagccagaatcccatactctttcggtaatttcatttctttatgctgatataaaattttttccaattcataaatcgcaggtgtcagaaatttatttttatgatacaccaacttaaatttgcggttccattcctgtttttcatcataaaacacccgaattttttcatgtgccagctcatgtgttaaaagacgaagcgacataacagaaagcactttattccaaatcactgcattgataatcgtacgtggacaatttgcctcccacgttaccttgattgaaatgtgatgccgtttcacatagtcctcaaaaagctgtcttgttccgcttccctgctcacgcattgcaaagcactgaccatttaattctgaatttgaaatttgaattttttcaaaaaatggatgccggcttccacatccaagtaccagacaatcctcaataatcggaatcacaaccaaatccggcgactgaatttctccttccacgactgccgcatcgagttcagatttcaataatttctcttcaatttcatgcgtattgctgacaaaagaatacacctcaagccccgtcagactctgttctaattctccaatcaaagttggcgcaaggcaagttcccactgttaaagtcgttcctagctgaaatcgctcattttgtccctgacttagcattagttcctctaactgttcaaactgactgaccaaatctctggcatgagaaagtaatagttttccacgctctgtcaagtaaagtttctttccaaggcgttcaaacaacagcccatgataatgctgttccatttcacgaattgcctgactgacggtcggctgtgaaagataaagatgttttgccgccgcactcatcgttccatactctgcaacagccaaaaaaatcgtaaggtatcgaatcgtcattgtttttatcattcccttttatctataggtaaaacctatcatttttataaaataatatcatttttcaaatacatcaacaagtgttatattatagttattaaaactggtacattgaatattaagcagctgctatatttacgctgtactggtacataaaaagctcaaggaggaataaaatgtcagcattaactgtcagcaaagaagaagaaaaacgtttaaaaggacttggcttcttaaataacaaaggaaccgataacttttctgcacgggttatcactgtaaatggaaaaatttctgctgctcaggctcagtgtttaacagaagccgcagaaaaattcggaaatggagtgcttaccttcactacccgccagactgtagaaattcagggcatcccttatgataaagtagaagcatttcaggctcatcttgcaaaagaaggcttaaccgttggcggaaccggtccacgtgttcgtcctgtcgtatcctgtaaaggaaccacctgccattatggtctgttagattctttcgcaatttccgaggaaattcacaaacgtttttatgagggatatcatgaagtaaaacttcctcataaatttaaaattgccgttggcggatgtcctaataattgtgtaaaaccagatttaaatgaccttggaatcattggtcagagagttccaaactttgataaagctctttgtaaaggctgtaaaaaatgtgccatcgaagcagtatgtccgtccggtgccgctaaagttgttgacggtgtcttaaacattgataaaaaggtctgtatccactgtggtcgctgtgttggaaactgccattttgacagcattaaagatggtacttacggatttaaaatttacattggcggacgctggggaaaacagatttcacagggtcgtgccttaaataaagtctttacttccaaagaagaagcaatggatatcattgaaaagaccatcttattcttccgcgaaaacggaaaaccgggagaacgttttgcactgacagtagaccgtcttggatttgagaatgtagaaaatgaaattttaaacggagacatcttaagcagaaaagaagaaattttaaaacgtgaactgtaaaaaatcccccgaggttgttaccaaaaacaacccagggggattttttatgctaaatctattaatttaattatgctaagtattcttttaatgttgctcttactgcaccaacacctgcaatctcttttacaaagatttcttcaatcagttcgccgataccagctttgtagaggtcaattccgaagatgttttcattagaaagaatggatttaagctgtccgttgtagctttccggtttgccaaattcgattccttttaattctgcttttaattcatccagcattgggtctgcggaaagttcaaacgcttctccattgtcatcaagaccaagaagatatcggcaccatccagcgattgccagcgggattgcttttaatttctttgcatctccgtatttttccacataagatttgatagtttctccgtaacggattccaactttctgagaagtatctgttgcaatacgctgtggagtatcaggcataaatggattcggaatacgagtgttgataacttcgtctacgaactctgccggagaaaggatacccgggtctgtaacaaccggcataccttctacaggaccgatttcatgaaccaatttgtttaactgttcgtctttcatttcgtctgcaattaaagtatatcctaatacacatccgtaagtagccagtgctgtatgcagtggatttaagcaggttgtaactttcatacgttctactttgtttacagtgtcacggtctgtcatgtaaacacctgctttttcaagagccggtctgccattcgggaaacggtcttcaattaccagatactgcggtccttctgcatttacaaatggtgcaatataagttctcttagaagtaataaccggtgcaatgtcttcgattccaagttcctctaaagatttgcatacagattctgccggtcttggtgtgattttatcaatcatagaccatgggaaagatacctgtgcttcatcggagatataagctacgaattcatcttctacgaatccttttttgttccattcttctgccattgtaagaatagaatttctcagtttttctccattgtgagagcagttatccatagaaacaacagctaacggagcttttcctgctttgaaacgttcatgaagcagtgcgcatacaacagccattgcagaacctgctttttccggaccattgtcgatatcgctctggatgaatgggaaataagttccatctgcgccttttaatgcataacctttttctgtgatagtaaaggaaatcatctgaaggtctttattctggaagatttcttttaaacgattccactcagcctctacattagactgtgctttgattgcctctgttaaagaagcgattacttttttatctgtacttccgtctgcttttaaggtaacacccagaaccagattgtcataaggagcgtagattttgtccactacatcgaagtcaaatgtctctacgcaggtaatacctttgtccatagctccgttggaaattaaagtatctgcgattccaccaatgaagatacggaaaatatttccgattccgaaatgtacccaagctggggatttctttgtttcttcttttactttttcaatatcataggatggaagcacaacgcctgctgcttcccagcttttcttatctttaataccgtctaatgtcagcttcatcttcattttcacctttctattcttatttactataattatttattttcgctttttgcttctttttcgattgcttcccataatccgcaaaggtaagctgcaccaagtgctctgtcatacagaccgtatcctggcattgctttttcgccccaaatcattcttccatggtctggacggattggtccttcaaatcctgtttcatataaagctttcataactgcatgcatgtcaaatgttccgtcagagcttaaatgagcactttcttcaaaatctctcattccatcattaaaacgaaggtttctgatgtgcgcgaaatgaattcttccttttaacatcttaacagttgcaactaaatcgttgtttaagtttgttccataagaacccatgcagaatgtaacaccgttgtgtttatttggcaccatttcaatcagacgttttaattttgcctgagaagaaatgatacgtggaagtccaaatacgctccatgatgggtcatccggatgaattgccatgttgatgtcgtatttgtcacaaaccggcatgattgcttccaggaagtatttcaggttttcaaacagtttttcttcatcaatatctttgtaaagttcaaacagctcttttactttttccatacgttccggttcccaacccggcattacagttccgttcatattgtttttgatagcgtcgaacattttttcaggatccatgctgtcgattacatcctgattatatgcaagaacggttgttccatcttctctcatacggtcaagttctgttcttgtccagtcaaataccggcatgaagttgtaacataccatgtgaatatctgctttaccaaggttctctaatgttttgatgtatgcttcgatgtctttgtctctgtccggaccgccggttttgattgcatcacttacgttaacactttcgatacctgcgaggaaaagtcctgcatcttcaacatcttttttcagtgcaaggatttcatccaattcccatacctctcccggcattttgttatacagtgtggaaataattccttttacataacagctctgacgaatctgctgtaatgtaactgtatcatactcttttccataccaacgcattgtcatttccataataaacattctccttatcattttgatttcttattttatgttttcagtttatgtgtatctttttctcgtatactagtatggtagtataaactcaaaattttttcaattcacattttcactatatatttttttatttttctgtgtattttgtacaagtttttttattttcagtttaaaccattgactttaagtctcgattttcagtatactagtatgtaagctgttaaaaggataacaaactctaattttcatctggtaaaaaacagtttcatagcgtataattagaaattagggtatcatttctactattagcaaagagagggtattttatatgataatacttaacagaaattcttctgaaacagcaagatcctatgccatgcgggttcttttatataacattatccacgttgaacttcagcccggaagtgcagtcagtgaaaatgaactttcttctgccctttccctttcaagaaccccgattcgtgaagctttaatcgaattaaaccgtattggacttgtcgaaattcttccacaaagaggaagttatatttctaaaattaattatgcaattgtcgaagaatcccgttttgtacgtcttgttatggaaacagcagttatcaaacttgcctgtgagtctattacagatgactacctgcttgcactgaaacaaaacattgaacagcagaaagcctgccagactaccaaagacggagaccgttttcttgaaatcgacaatgaatttcatcgtcttatttttgaatgtgcaggcaaaatgtggtcctatcattttgtagaagaacagatggttcactttgaccggcttcgtgcacttgcagcaaaatccggatatgcgaaatcaacgattccggatcacgaagatattttatatgcattaaaacgaaaagatgctgaaatggcagaaatttttatgacccgacatttgacccgatatcagacagaaaaaacggaaattatgaaacaatatccggaatatttcacgaaataaaaaacagaggtgtatcgtttttaagcaatacacctctgttttattttttatctattaagtttttggcacatcaacaatgctcaagatatgacgcagtatgatttcttcatattatttcataattggttctaacgctttagctaatttctccttctcagcctctgcttcttccagattctttccaagtgttgtgtaataaatcttaatcttcggttctgttccggatggacgaacaacaacagtttcaccgttatcaagtttgtaaattaaaacatttgcagatggaagtcctgtttcttccggttttgtatagtctgttactttgacaatctgatgtccggcaatttctgtcagtggtttgtcacgaagtccctgcattaatgcagacatcttgtccattccactcaagcccgggaattcaaaactgtctactttatttaagtaacgaccatactgtgcgtagatttcttccattctctgttttaaggaacttccgatacttctgtagtatgcagccatttcacaaatcagcatagaaccgattacagcatctttatcacgtacatacggtcctgcaagatatccataactctcttcaaatccaaagataaagcggtctacttcaccagcttcttcaagctgtgcaatctggtcaccaatccatttaaatcctgtcagtacgcttctgagttctactccgtaatgctctgctactgcatccgcaagtggtgtggaaacgatagattttactgctaccggattcttcggcattgtgcctttttcgatacgacctgcgcagatatagtctaaaagcagtacaccaacttcatttcctgttaccagttcataggagccatccgggcatttcattgcaataccaacacggtctgcatccgggtcagttgcaagcattaagtctgcacctgtttcttttgccagatttaatcctaattccagagccgcaaaaatttccggattcggataactgcaggttgtgaagtatccatttggatattcctgttccggaacgattgtgatatctgtaattccgatatcttttaatacctgagtaaccggcacaagaccggaaccgtttaatgggctgtaaaccagtttaagacctgctgttttgcaaagacccggacgaacctgacgagattcgattgcttcgtaaagtgcttttttgcagtcatctcctacaaaacgaatcagtccttcttccacaccttctgcaaaggacatatatttggcacctgttaatacatctgttttctgaatctcttcatatacaattgcagctgcgtcatctgtcatctggcatccgtccggaccataagctttatatccgttatattttgccgggttgtgagaagcggttaccataatacctgcgttacattcatagtaacgtgttgcaaaggaaagtgccggtaccggcattaaagcgtcataaattctgactttaattccatttgcagccagtacacctgctgcattttttgcaaatacgtcactctttaaacgactgtcataactgattgccacagtctgatttccgccctgtgtttttacccagtttgcaagaccctgtgttgcctgacgtaccacataaatgttcatgcggtttgttcctgctccaagtacaccacgaagtcctgcagttccaaattttaatgctacagcaaaacggtctttgatttcttcatcgattcctttaatttttgataattccggattcaaatccgcatcttcaaggtctgctgccagccagcgttcatattcttcttgatacatttttaaccactcctactattctattttttatgtatgtataaaacgtaactatactataccatatttttggtaaaaccgcaataaagccggaggactttgcacctatttttgtgctcttttttcgacaaaatatacaatgattattggttttctattttttctcaaacttttaagttctccccaaaaaccctaaaaaaataagttgcttctacagactgatgcagaccctctttctggcggttttcaatcatttgatacactcgttcatgtgcttcatacaattcttctttccttccggactctaacattccctttactgattcatatctcgtagaatatgtgagaacgcgcataattgcgtttattttagaaatcatagagttatgtcccatatctgtgattgcatcatgaaactcgttatctgcctcaaatacagcatctacatccggatgttctaccataattgtttcttttaaatgaatcattctttctttcagctgtgcaatctcttcttcactgcatttttcaacagcaagacgcatcacacctgtcgctaccattgctcttaattcatgcagttcctgttcattttgctgattcaagataattccataaatcattgggtcaatcagactttctgagaagccattacatacaaaagttccttctgctcttttaatttctaataccccaatataaaccagaatctttattgcttcacgtatggaattgcgtgccactcctagctgctctgacagctccatttctgtaggaatcttatctcccggttttaattccccactcagcatcgcctgtgtaagacggtcaattacacgctgtacaactgatgaccggttaattttttttaagtattcaggcatcgctcatactcctttcctcgtttttgtgtaacattggatgttgttcattccattatacttggtacgattcgataaaacaactaatttattcgtgatgtacaccaaaatttttgatattcacatcatactttaatcgaataacagaccagatccaacaaaaatccggtcgtttgcaagcaaaatcgcctgcaaatgccggatttttaatatctttttattcctcatcagccctaaaatttgtttaggggagattttttcgaaagttcacaaccatggcatccctgccatggcaaatctctttttgttttttatgttctaatttactatcttaatgcaccatcggaaccaaagttatatttctttcctccaatagtctgccagccggttctcattgctccgtcatttgctccgccaaagtaatatttctttcctccaatggtctgccagccggtcttcattgctccgtcatttgctccgccaagataatatttctttcctccaatggtctgccagccggtcttcattgctccgtcatttgctccgccaagatagtaccatttgttataaactttctgccaaccggtcttcatcgctccatcattttcatgtccgagccaataatatttgccatagatcttttgccatccggtcttcatcgctccatcattggagtgtcctaaccagtaatacttaccatatactttctgccaacaggttctcatcgctccatcacttgccaaccagtaatatttaccataaactttctgccagtaagttttcatcacaccgtcattaccaaaccagtagtaggaatcatagatataattccagtaccgagccatatctccatattcatcaaaataatgagcttgatcataaatatcccaataccagtaatttgtcatcggaattccagaatcatctaagatgtaagtatgattgattccatctatttcaatttcaagcattttataggacatgtattccgatggaacttcaagcccttcaattgggaacccttcatcattatcatagtctccctctgccatataataatgataactgtcttctcctgtcattccatccgaccatataagatagtatcctccatccggaattcctgccgatcgatcagagtaatccgcaatcagacgatatcttaaaggaatctctccgaattcatattcatatctgagtcctaccatgtatgttccggtgtccagcgtatccggcactgcattcggagcatcactattataacatctccagcgcttgtcatttgctgtataaacccatttgctttcaagcttattcttcgtatgtgcattatcataattacgatagattactttttgaatttctccactgtaaaaattagttacaatttcctgtgtccactcatcgccttgcaccacttcaccggtcgacatttcatcggaccagccagcctccacagcggcggctgctaccggtgcaggtacaaccgaagtgacccccaatccaagtgctaaagcaactgccaatccccctaatctttttctcttcataacgtttcctcctctcggattattagtacttatattgtactatattcttcgaggttttccaacgttttttctgaaaatttcttaaagctttttgattttaacaattattttcattaagctttttttctgtcgcacgaatccgaatataataactaatgcaaagtaacaatgcagctccactccaggcagcaatctcggcaaaaaagattccattttgaccgataaaaatcggaagaatcaaagccgcaccaattcgcatcaagaactccgcaaatccacttaacattggaagcaaggtatctccaagtccctgaagtgccgaacgatacacgtataaaaaatataacacccacagcatcgccgccataatagaaagataatgaaacgcaatctcaagtaccgcttcgatctgctgttgctctccggagaggaacaaggataagattggtttcccaaataaaaacattgcaacggaaatcacgattgaagtcgcaagcgaaatcaaaagactgacccgaactccacttttaattcgatcaaattgctttgctcctaaattttgtccgacataagttacgattgcataaccataagaaatcgctgccatctcaagcaagccatacaacttattagtcgcagtaaatccggcaacaaataagaaaccatagccgtttattacatactgaacaaccaagcctcccactccgataatgatattttgaaaaactaccggaattcccagttgtagtaaatttaaatccagttttgcctcatgctcaaaatccgattttgctaactgtaccagcttaatttgttttaaaattgcaaaacaatagattgcagaaaacagctgtgcaataattgttgcgattgctgctccggcaattccccagccaaacacagcaacaaacaataaatccagtacaatgttgataagcgatgcaatcagcattgccgtcaatggtgctttactgtttccaattgcccgcagctcacaggcaaacatattatatgccgtcgtaaatggaattccacaaaagataattcgcagataaagcagcgccattccaatgatgttttgcggggtatgcagtccggtcaatgccgctgaagccaacagctggctcaaagcaaaaaccaaaacggcagtaatcgcagttaaacgataactatgcgcaattacttttcttaaagcgactccattgcctgccccgtaatgctgcgaaatcaagattgaaaatccctgcgtaattcctgttgaaatgcctgtcacaatccacattaaaaaatcaactgagccaagcgctgccaaagcctctacacctgcaacctgaccgacaatcatagtatctaccatagtataaagctgctggcaaatgttcccaagcattaacggaagcgcaaaaaagaagattaattttgcggcatttcccgaagtcatattttgcgtctgtgccttcataacatctcataaatcctttcaaaaaatacgttttttatcctttcagatattaactctattctaccatattgccctgtaaaacggaagaaaagggactgaaattcactccctttttttatgtgtttttttctccggaagcaccaacattgcaagcgctgctaatacgataattaaccctgtaatggaaagcacagttgggatttctccaaaaaagcaaataccaaataccattgccgcaaccggttcacatgagcacaaaatggatgccttacctgcatccatatggtccagtgccactgtgtaaaatgcatatggagccaccgcaacacataaagaatgcaccaacataaaccccgaatgcggtaacggattttgcataatatactgcgccacatcgccccattttgcaaacggaagcaggattactgcaattgaaaggatactataaaaagtaatcgtaagcgccggatacccacgtctcatcccaactttagaaaagatgctgtacatcgcataaaaaatggcgccgacacttccgactaaaattccaatccaactccaatgcatactctcatttgtttcaaaaatcccacttgtcaacacgcagccacaaattgctaaaaaaatacttaatacttttcttcgcgtaatcgcttcatgaaagagaaaaaatgcaacaatcatgaccacaatcggagaaagtgcaagcagcaccgctgcaagcgaaagcgacaactcattgatagcaaaattgtaacatacattcacaccaagtgacccaagaagccctgctccaataaaaatccagcaatcttttaaatgaattttaaaatactccggatgcgaatacgcaagccagattccaagcaacagtactgcaacaatcaatctcgaagccacaattgtggtgttattcatatctccgctcaatttgcgcacaaaaattccggcagaaccaaaaccgattccggtaataatcggcataaaaccatataattttttcatctttttaccaactttactctcattaacaatattttttcagaatttcatgcatcttttcaaactgctcttccatctcttttaccagacgaaactgcgttcttgcgcgcaccagattgtgctccggatatgatgttttaaagtatacatcaccctgaaggaaatccgcaagaaaacgcattccacactctaaagtcatcaatctggctccccatggaaggctctcaatttctgccggagtcagcacatcttttgccatctccagatatcccttcacatagatttcataaaggtcgatatcaaagtgtactttgtccaaatctttttcatcttcttctgcggtagaggcaccaaaacgaatggaatcgccaaagtcgttacacgcaagccccggcataatcgtatccagatcaatgatacataagccctgatccgtatctttatcaaacaaaatattattcaattttgtatcattatgtgtcacacgaagcggtaagactcccttttctaactgatccatcaaaacattacaatctgctttacgagaaagcacaaattcaatctccggatggcataatttggcgcgatttttcacatcttttcgctgcgcatcttcaaaatcacgaaaacgctttgcagtgtcatgaaactgcggaatcgtctcataaagactgtctgctggataatctcccagttgctttaagaaatgtccaaaactaagtgcagattgataaaactgctccggacgctccacctgctgatagcacacggaattcggcacataatgcagacaacgccatggctgtcccttctcatcctcaaaataagtatcgccactctttgtcttaatataagataaggattctctgtctaaatcgccaccgtcctgacgaataatattacgcaaatattccgtcactccaaaaatattttccatcacctgatctggatttttaaagacgttaatgttaattcgctgcaatacaaagagcggcacatcatttccattttcatccggcaaatagactgcataggtctcattaatatgaccttctccaaatggctttacatagctgcagcaatcgccaaatccaaacgcataaatcgcatcttccagacttcggctatctgcaccttcgatggttcttctggtagagaaaatcacttctcctgcttccacttttctgcccggctcaatcacacaatgtgcttttactacgctgccaagaccaacatgtgcgccttcttctacaatcgaatcatggtctaccactgcaccgctgttaataagtgctgccattttgattgttgtattcatatttaccactgctctttgcataacaaaacaacccggctctaagcggacactcggactgacgattgcagatggatgtacgattgcaggtacttcatactcctcttcaagcaatttttgagtccaaaataaacgcgtcttgttatttccaaaagctgctaccgctactgaataatctctatgatacagatgataatcgcagcatctgccaatcacatcatcatcctttgcggtatcgtctaaaaataagacttcctcataaccaagtgccaatgcggtttcttttatcattcttccaaaaccgcctgcaccaagaattaataaatttttcattttcctctttccttcttttttatcttgagagcgtacgctccgatttgtattctataaaatttataaacgtaaacctattttatcatctacttctcttttttttcaataatacttattaacacttattgaaaaaaccttgaatttgcccagaaatttccttttgttcgaacttatcctgcaaacacttcttccaaagtctgatatttaaataccggaaaatcgttctcatcataatgtactttcattatcatagcatgacggttcggatcatacaacgggtctcccacaatttcatcataaggtcttgcatgataaacacacaggtctgtcactccatcttctgcttttacaaatgagttatgaccaggtccaaagactcctgctgcataatggatttggtaatgcaatcgaatatcttggacgatatacccacaaggttgctatctctaacagccgaatcatctctgtcacggatacacacacaacattcactgcccgtggcagaaaaccaggtgaccctcgccgtacgattaccctcagtaatgaggagtttatcaggcgcttcctcagtgaagaaatctgctcttcttaactactctgaatctgatactttcctaatgaattataacatgaataatcggtatctcatagataaaaaaggccagataatgattttttctcattacctgacctctctcctagtctatcgcatttaagccacttccccagattacaactccacttttactgtcaagtgcagtaaatgtcatgacatatttcttcccatcttcatcccactgttttaaagcaatccctttatactctgcctcgtcggtctttatggtaatattataatctccacttaattcccaagttccctcaagagccccacttatcgtattgtttttattcaataccagttcttcagactctttcatatccggagagatatcacgtccgtggttaatatatttatacgttccaacaagctgtttactttccagtttttctgcactttcttcggtatagcggtatggcgcaataaccggccagccttcttcattaaaaaacatctggtgtacacgcacttcatgagtttctccgctattttcaaatcgtgtgtgataaataataaaatattttccggtttcttcctgatacagacaggaattatgacctggtgaaagatagccttttcgatcttctccttcttctccttctttccaggtaaatttataaccacccattaattttgttccgtactgttctgccgttgcatcactaaaggcacttcccgccggacctttacaatctttcatgtcctgtcccatggaatctacataaggaccattcgggttctcggaacgacacacacggatattatagcctccatctgaatctaagcctccaaacgataagaacatataataatatccggtttcttcattatagatgacataaggagcttcaattcttagatgatttcctccaagcagtttttctccatatccgctctctaaaggcattccgctctctgcatccatttcttttacaaagattcctccggaataagagccataaatcatccagagtttcccttctttatcataaaatacaaccgggtctaccacatttgggtctgttgtcgcctgatacagatttccatcttcgtccttctcacttgcactcattccggattttagcataattccctcattgctataaggtccttccacagaatctgaaactgctgttccaagacaggatagcggagagtcccctttgcaattacaataatataatttataacttccatcgtttaattttatgacgtctggagcccaaaacgtattgctctgtgaccactcaaatgcttctttcatttcttttaatacatttggaatcaccgtattattattttttactccctgattgacatacgtccagttcattaaatcctctgtttttgctactgcaagatgtgagccaaaaatataatagcttccatcttctccctctataatcgatgggtcatgaaccgatacttcagaaaattctttttccaccggagtatctgcttttaatttttctttttgtgcgccacaacctgtcattaacatgagagacattgcagcaaacacaattgctattttttttcgtttcataaattaaatccttctcctgtaaaaaaagcccaaatggatatcatctaccttctatccatttgagccttttcttatttttttgctatttccatcggactataggcaatccgaactttaatatcctgattataatttccaaattcacttccgaaaatggtaattccaccgatattttttgcatcttcttcaatttcaaatttaaatcttaccgtgcttttataatccagattaaattgattaattgtaacatctgagattttcaatccatctacaaacgttccctttttattaattacaatcatctttaacaatccatactggttccagtttggaaaccaccagtccggtgtaaagattccctgtacatctccatagtctcccggacttgtccaagtaccgatttttacatcattcaggaaaattgaaatatccgaaggccagtcattattaattcccggtgcctctgaactgatttcaagagaaaccgtaatctggtcaattttggttgcactcggcaacagatttggaatcatatactcaatatagccttttgtaaaccacaaaattccagcattgattctatccggatgagaaaaataacgtgggtcatctacctctccgacaattgccttacttgtagcaagtccacaggtcggatatacattataatccgaataatgtcctactttcacttccgtgttataaatattctggtcttcttcggtttcttcagattctacatcaaccacaatcttatcaactgcaactttacagattttctgatttccatgtcctccgcgttctgtcataacctgaatgattccactttcttccagctttttgatatgactggtcagcgcaccatttgtaattccaagacttgttgcaagttcattcatgttcatctcatggttttcctgaagaagcttgataatattaattctcagttctgaaccaagcgccttgaaaacctccaggccctcgtccaaatttttcacatgcaacatcttataagtcctactttctcagaaataaatacctcgtatcttcaaaatacctttagattggtctaaagtatactataccacgaattttccccaatacgcaagacctaagttgttgattccggtcagcacatacccttttttttgattttcaatatcacagcatgaataaataattccattctgaaaatattcactctctttatccagtgtacagacctttgactgtttcatattgttatcaaattcatcaaatataattaattcccagtcgccttggagcttttccatatccggtttcgataccggctcaaagttctctccctgatatggttctgcaccaaataccggccagtcattgataaaaaacatcggccgtatcatcatataatgaatctgatagctatccctgtcttctgcttcctcataaatacgatttacctttgcaccatcccgtacatgatgcacaaaataataatgttccgactgtgggtcataaaatgggacaccatgccccggtccacgaaatcctccccacttccagtctttttttgctttacccactcttggatttaccgcttcaaactgataactccctgcaagttttatccccattccttcttctacaagtgaatttccatgccagtccagatacggccctgtcacgcacctgcttcttccaacacggatgtcataagtatctccaagccagccataagactgaaacagataaaaataacctgtctcaggcgcataaatgaccgatgccccctccggtccgtcaatcaatgacttttttgcttttcttgagatacagttgccaagctccttcgcatcatttgagagagaaagaccacttgtggcatctaactctttgatataaattccaccaaagaaagaaccatacactagataacacctctcgttatcccagataatatgtgcatcaattgcatttggtgctgtatcatccgtcccccaggtatctgctacaattcctctgttttcaaacggtccaagcggatgtttagaaactgcaagccagattcttgattccgaactgccaaatgcttttgttgctgaataatacatccggtattctccatgtgtatattccacataaggagcccagaaattcacagtctgtggatactctccgttgtctcttccttctttgatggccttttgggaaagcgcaattccttcatattcaaaatgaatcaaatcttttgagcttctgaccggaattccgattttttctgtcagcccatcttccggctgatatacatccgtactataagagtagtatttttctgtcaccgggtcccacatcatagaagggtcatgggaccacagagatgcatttttaaaaacgctgccttcatttaatgttaatattcctgttttcaaaatttctcctctttttaaaaaagggctgttttcagaatatctgaagacaaccctatctctttttcttttcttatccttttacaccggatacagccatagattcaataatgtaacgctggaagaagaagaacaacaacagcgttggaagaatcgaaagcactgacgcagccataatcagaggataatcactgtttaccgcataatatgcattaaaggaacggatgacaacctgtaacgtaaaccattcttcattctgaataaagatggttggtgcaaggtaatcattccagattcccataaaccagagaatcaactgtgtcattaatgcacctttcatcaacggaaggaagatgctccagtacatgcggaagtaactacatccatcgagttttgcagcttctacgatagaatccggaatactggtcagattctgtcttaagaagaaaatgatgcttacatttccgaataatcccggaatgataagtggaagcagactatttgtccatcccatttttgtaaacattacatactgcggaatcataacaactgcaaatggaatcatcatcgttgcaagaagtcctaagaaaataccattttttcctttgaattttaatttactaaaggaaaatgctgcaagggaagaagtgaatgctcccactaccaacaccggtattgcaacagttaaggtatttcttaaacctcttaaaaattccggtttctgcaatacttcagagtattttccaaatttccaagggtccggaataatactaaagtttgcagaaagaatctggttctttgtcataaaagaacttaataccatgtacaaaagcgggaataccattgcaaccgctccgattaaaagcagtaaaaatataatgccatctatcgtttttgctttttttgtttttacttctgaactctgttcatctaattttgccatattcccacctccttactcgattgtcttaacccacttatcctgacccttaaagttaattgctgttacaataaagattaagatagcaagtataaatgccattgcagaaccgtatcccatctgattatttccaaaggatttatcatacatatagaatacaacggttgccgcactgtagtttaatccaccatttggaaccataacaagtacttctacaaatacctggaatcctccaatcaaaccggtaatcaacagatagaatgtaaccggtgataccagtggaagtgtaatgtgacggaataatctccagccgctggctccatcaatttttgctgcttcataatagtctcttggaatactctgtaaaccggacaggtaaaggacgatagaaccaccaagtcctttccataccatgaaaataatcatggatacttttacccagaactggtcacctaaccagtttggtccgtgtataccggataccgctttgataatactgtttaacagaccataatcatagttgaatacccacatccacagaattgcaactgcaactaaggaagatacaaccggtacatagtataaagtacgaagaatcttaattcctctcattttacgattcattccaactgcaatcaacatagccagtgccattccaatcggaataccaagcatgtaaacaatggtatttcctaataccttccagaattttgcatctgtcaataattttgcatagttctgaaatcctacaaaattatctaacatgctgttcataccattccattttgtcatactggcaatcagtgcaaacacaatcgggaatgccatgaaaatacagaaaccaatgaacggcggtgctacaaatgccagtccccagcaatgttctttatatgccgcacggttcattttttgctttgttttcgttttgctcatctcttccgctccttaatctttaaggaagcaaagccggaataatccggtcctgcttgaatttactattctacactctcccatgcttcatccagagatgcctgcatctgaggctgtacctgctcgatgtattcatctactgtcatagagccatttttcacgttatcaagtccttcaaggaaaatgtcgttccattcagcatttggagtataagttgtttcctggaatcttccctcgtatttgtctgttccctgtaaatagttaaagaatacatttacatttgatgggaatgcaagtgttccatcttcaattgctgtcataaattcaccgtcagcaaggtctttcatatttggcaactggatggactgcccaccttcgataccactaagctgtttctgtccggcatcatctgtacacagataagaaaccagttcagttgcttcttctttatttttactgtttgcagatacacagaaaccaactgttccaagccatgtcatggattttccggttgacagtgtcggatatgcacataaatcccagttgaatgggaatgtttctttatccataaatgctgctacgtcccaagtaccacatgcataaaatgcttcctgtcctgcaagccatctctgatatacaccaagagaagcatcctgttctacagtaggagtaattccaagttccagtgtacagtcaacatatttctgaagtgcttctttaaattccggagtgtcaatggttactgttttgtggtcgtcacttaagtagcttgctccgtttgaccatacaaatggctgaagcatgaatgcatttgcaaatccacatccccactggtcgatttctccatcaccatctgtatctttagtcagttttttacaaacttcgatgaactcatcgtatgtatatggattttccgggtccggataatcaagtcctgcttcatcaaataaatctttattgtatgcataagcaaatacggatgcatcttttggaagtgcatataaatcgccacttcctgtcttatctccatcatagcgatagctgtctaaagcttcctgtgctaacattccatctgtgctgattccttttttatccagaatcggctgaaggtcttcaatatatccgttctcaacaaactgttctactgattccggtccaacataaaagatatccggcaaatcccctgctgtcatcatacctgttaatgttttggaatattcgtcctgagttgtaatctgtacatcaatgtttccaattgtatctgcatggtctttcttatactggtcaatcatgcttttgtatacagttgattcatgatcatttgcaaagataaaaatagaaaggtttttctttccgtctgctgtttctgatgaatctttgcttccgccacatcctgctaaaagtgatgtagccattactgctaccagtcctgctgaaactaatttctttaacttcattaagggctcctcctctttcttcgatagactatatcgtacttcgtttctaaagccatactagcacttaattttagatttagcaatagttttttatatttttctaaatattcacatggttttcgcttttttctacaattctgtcattttgtttttgtgcatatttttctaaaatatttagattaggctaaactatatttcttatgcaaatacctcttccattgtctgatattcaaacaccgggaaatcattttcgtcatagcgcactttcattatcatcgcatgacgatttgggtcataaagcgggtctcccacaatctcatcataaggtcttgcatgataaacacaaaggtctgtctctccatcttccgcttttacaaatgaattgtgtcccggtccaaacacaccggcttttacatctgttttcagtaccggatagcgcagttttgtccagcacgctgggtctaacaggtctgcatcctcatcgatagaaagcatacccatgcagtaacattctccggttgcacttgctgagaaagtcatataaatttttccgttatgttttaaaattgccggtccttcatttacccagaaatcaattctttcccagtcataatccggtgttgttaaaagtacctgaacggttgcaagcttgtttggtgtttccatttttgcaatgtacaggtttgaaatctgtttgccaacccctgttttttctgcccagatatagtaataatcccctttatgttcaaatactgtcgcatccagtgaaaatgcatggaaagaaaattcatcttcatttgctgcctgcatcattcctaattcttcccattcatctttcatcgggtcttgtcctttacaatgaagaacgtaaggacgaatttcccagatgtcatctttatcccctgctgcgtagtaaatgtaccatccaccgtctacataatggatttccggagcccaaatatgaatactctgtggtccttcttcatgctttacccaaagtgttttctctttggcctctgcaagtccttttactgtatcggaagaacgaagcacaatcttatcatattccggtacggaagcagtaaaataataagttccatcctgactcttatacacatacggatccgccctctgtaaaatcaatggtttgttgtacttggtttctttatagttatttttgttcattcctttttctccttttagattaatgtaaattaattttatattatttaaatataaatttcaatagtattttagacttttgtaaaatattactgattccaattcggcttttttgtgaatgattttgcggctttttgtttgaattttatattagattattctataatattatacggaaaccaaaacatttaagattttaccgccaaaaatggcagaacggagacgatttttttatgaatctttttacccatgacagcttgctgtctcgatttttctatcttgtaggagatatcatcacccttcattttttatggattttatgcagtcttccaattatcaccattggagcttccactactgctctttattacagttgtatgaaacgtatccgtacgaaagaaggatacccgcttaaaaactttttttcttcttttaaaataaattttaagcaatccacacttatctggattgggctaatgattatcggatttgtattttttacagactttcgaattgccatggcacttgaaaatacactcggtcgtctgatgctggtgacctgttcctgttttcttattccataccttctcatttgcctttatatttttccggtacaggcaaaatttaaaaataccatctacaataatttaaaaaatgctttttttatggccatccgtcattttccattgactctgcttttaattgcaatcgatgccacttttattctgcttttcttttctttcgttccatttattggactggcactttgctgtggagtcggattgcttggatatttaaatgcgaatttatttgtttttatctttcgtaaatatgtacccgatgaattagaacacgacctagaaatctccggtgaacgattttaagaggagccctttttatgaatacaaaattcaaaaagactgctttagaagatgatgcagagatttatcagcacggcacaaaatcagccacaaaagacgatatcaaaaaattgccgcccaaaaaacgtatcgcttacttttgtgactactatctggcaaaatgtcttgtggtccttgcccttatcatctgcatcatccttattatatgcgcaagtatcaatggaaaacaacatacccccgtactttctgtcgcactcatcaatgaagtctacctttcggatacggatgccctttgtgatgagataaaagaaagtcttgaactagatgaagatgccatcgtaaacgtcacttattacaatctcaacgaatatcaaaataacatgtcttatctggctcatctttctgccggaagcgtcgatgtgattctttgctctgaagaattttttactgattctgctccacagggaatgtttgcagatttaagtaccctgctttcaaaagaggaactttctgcttattcctcgcagttaaaagaggcttctattgttgataccgacacagacggaaaaatcatttctaaatctgaacctgctcctatggggattgatgcaggaaattatattatctgtctaactgaaaaaggggacaacccagaaaatgcgaaaaaagcagtttctttctttacgacacacacagactgcctgaacccataaattcaggtagtttgtgtgttttatttttgaaatagacttttccctttataaaatttctggtatggttaaataatatcaattacaatattcctgcttatttcaattaaataaactggccgaagtaaaaggcatgccttctgttaccttaaaacaacgataacgcccgttttaacgatgcattaaatccagaaaaactcgaaggaagctataccttaaatggagagcttaataccagtgttaccagtcctatcgcagatgctgccaatcagttaggaaatggcggtctttctagcgcagacgaagcattaaatttatcaaaaagagataacataaaaaagggacggagtttgtagcttgactaagccacaaaccccgtccctttttagattattctctgtcacgccttctgcttaggtacaaactcaattttgagagccattcccataccatctgctaaccgtttcagtaaattaatagaaggatttctagttccattctcaagcttactaatatctgcctgattaatacccgtacgctcagcaagctccttctgtgtaagattctgagaagttcttgcatctacaatcgctctgataacatccatttctggttgaattgcttcatattcttttttaaattcttcattttctaactgcttagagagcatatcatcaaatgtcctcatctctcatcatcctttctatgaaatcttttctcctgtcttttgcaatctgtatctcctcttttggagttttttgtgtcttttttacaaaaccatttgtcattataattttttcctcacaataaaaaaatacaaaactctggtaatatcacttagaagtattttctaatctctaagaggttttctacgcatccatataagatttcttttaatgcttcttctggttctgtctggtccggaaccatcacaactttacaccctgcacgataggcacttaagactccatttggcgaatcttccactgccatacattcttctggcaaaagtttaagctgcctacaggcatattcataaatatcaggcgatggctttccgtattctaccattgttgcacagataattttatcaaaatatggttctaaaccaatttgttttaagtattttctggcacgttcttcatccgttgccgtagcaatcgcacgtttgacattttttgtttttaaaaattcaagcagttctactgctccttttttcagttcaattccattcttttgaagacattcttccatgatttcttttcgataattacgaattgtagtgtaatccagattctcatcatgaaacatctcttttaaatgttttggcgcatagggtcttccaagagagcgcatactaagtgcctgttcatcactcatctcatatccaaaatgtgccagtgcctttggccagaaaatccggtaatatttctctgtgtcaattaatgttccatccatatcaaaaatgactgcttttatcatactgattttttcattccttctctttttattcttctgttttattcttctgccttcgcatcaacccactctacggtatattcttttccgatttgttctcctacatttttcacatatccttcaatcaggcttttcgcccgttcttttgcctgatttaaaagatttccattctcatttgcagtttcttccatgtgattttgcgcctctgcaagtgcctcggtttcttcttcttttgtgattttagtcataaatccggtatcggtaagaggctctcccatagaatcctcgtctaaatccacactcaaaatctcagcatccggaatggtcacctttaccacgccgtctttgcttggtttggaaacagacaccttgctgacatctaccccaagttctacaattccactgtactcagtccagatttttttatatcctgttccaagccatttaaacaatccgctggcttccgtctctgattttgctacattgtgataatagcattttaaagttgcaagttcacagacggattgaattgctgaaaaatcagcctcttttttttcctctttcttatctgcacacccggtaagacacagcatactgattactaaaagacaaagtattttttttcgtttcattttattttctccattttttatcacactttaccactgaatcgaatacccttcatgttcaagaatcggtgatagcaatgcttcgattacagattccagattttcctgggctgtttcatataatttatctgaatgatttgcctcattcattgcatcttctttacaaagcgtaatgacttcttttaaagaaaggtctggattctttggaatatagctaatcgaattttcatctagcgttgcaatattaatctctatctttggaagaaccggtgtcacagtctttttttcttcattgattttaaatgtcacctcttccatgttaattccgactttcacattggcatcatacgcaatatagcagtctatctcatccggattttcttgattatgtttttctgctacaccgttataaacaaactctgcggtagaaagctggctgatatttatcgcatcttcgagttgagaagatgtaatggtcgtttcttttcctgccttgttcatcacgcccggaagtaccagacctgctcctgctgcaattgccacaatcagaacaagtaagacaagttttttcttcatagtattctcccataattttaaagttttctggtttcctgctattttatcatattttattaaatctggaaatacaatgaaaatgcacaaatgttcttgcaagtcgaatatattttctatataatgatgtttgttgtgactttagatttacaaaggagagaaacatgaacgaaaataaagagttcaagccgtatattccggctgaaaaagtgacacctgaatttacaatcacttctattgtaatgggtatccttcttgcaattgtgttcggtgcagcaaacgcttacctcggattacgtgttggtatgaccgtttctgcatccatcccggctgctgtaatttccatgggtgtaattcgcgttatcatgcgaaaaaactccattttggaaagtaacctggtacagactattggctctgccggagagtctttagccgctggtgctatttttaccctgcctgctttattcttatgggcagcagaaggaaaaatggataaaccaagtattattgaaatcacaattatcgctttaatcggtggtctgcttggtgtgttattcatgattccgcttagaaacgcattaatcgtaaaagaacatggcgtacttccttatccggaaggtactgcgtgtgcagaggtccttttagctggtgaagaaggtggagcaaatgcttctactgtatttgccgggcttggtattgctgccggatttaaattcattatcgatggattaaaactggttccaagtgaagtatctttccgagtaaaaggatatgctggagaaatcggaacacagatttacccggctgttatgagcgttggttacatctgtggaccaagaatttcttcttatatgtttgccggtggtattgtcagctggctggtatttattccagcaattgtactgtttggtaatgatttgactttatatccgggaactgctcctatcggagaaatgtttgcagccggaggcgcaagcgcaatctggggaagttatatccgctacatcggtgccggtgcactggcagcaggcggtatcatcagtttaattaaatcccttcctctgattatccgtacgttccgtgatgcacttaagagcatgtccggggcaaaaggtacaagtaacaaacgtaccgaacaggatttaagcatgaaattcttattgcttgcaatccttgttctgactctgcttgtatggttagtacctgcaattccggtaacgctcgttggtgcgattatcgttgttatctttggtttcttctttgcaactgtttcttcaagaatggttggtcttgtaggaagctcaaataaccctgtttccggtatggcaatcgcaactcttctgattgctactatcatcttaaaaataacaggtgaccagggtgcccatggtatgcagggtgctatcgctatcggttctattatttgtattgtagctgctatcgccggagatgcttctcaggatttaaaaaccggatatttactcggtgcaactcctaagaaacagcagattggtgaaatgattggtgttatcgctgctgcttttgcaatcggtggtgtattatatttattagatgctgcatggggctttggtactgaacagctcggggcacctcaggcaatgttaatgaaaatgatcatcgaaggcgttatggatggaaatcttccatggactcttgtattcattggtgtattcctcgcaatcgcagtagaaatcgtaggaattccggtacttccatttgcaatcggtgtttaccttccggtacagctcaatgcttgtatcatggtaggtggtcttgttcgtcttgtatttgataaaatgaacaaagagcagaaagaaaaagatgcaatcatcagcgacggtatcttatattgttccggtatgattgccggagaaggcttagttggtattttactcgctatctttgctgtatttggactgaatgatgcaatcgacttatcttctaaattaaatctttctacaccggtagctaatatcggaagcttagttgtatttgctctgattatattaagtttattgaaattttccgtctggaaaaaaagaaagtaaatgatgaaaaaaaataacaatgtgatttcagagaattatctggaacgaaaaccaagccgaccggagggcatctcctggtcggctgatgaaaatggaattattacactcgacattgaaaataccggtgcttttaaccgaattgcgcaaaaattttttaaaaaaccaaaagtcacacatatccatctggatgaaatgggaagctttgtatggcctttattagatggagaaaaaaatattatcgaacttggaaaagaagtcgaaaaacatttcggtgaaaaagcaaatccattatatgaacgccttgccaagtattttcaaatattagatagttatcactttgttgagtggaagtaaaaaatagctcttatcatgaaattgaattttcacgataggagctatttttatttacttttattatttactttttctttttgacacaattatcatctgagcttataatatctgtagatttttttaatccaactttaacgaaaggacaccttttatttatgtttcaatgccaatccggatacacccttcgcaaaataaaagacacctgctatttactgccttatggtcagcaaatcgcagatcaacgaaaaggcatggttttgaatgaaaccggaaccttactctggaatcttctgcaacacaatgaaggcatggaatttgacgaccttgtaagtgcgattgccagaatttatcatttagactccgattcaattccaatgctttgtgacgatgtgcgtgactttcttacacaacttcaagcaaacggaatccttgtagaggatctccagccagtttccaatttcactacaatttacttagaaattgccggactcaaactgcagatttatgacccaaagcagcttctcttagagcaatcggcactcacgcattttgactcttttggttttgaaccggattcttccccaaatgccaaagctgaccagcgctttgaactgcttacaattcctccggcaagccacgcttatggagaagtactgcttcaaaactcagaactgagcgtatttgaacacgccaatcattacatcatcgtctttcatcctatgcaaaatttatatgaagcgcatatgaccaaggacggaagttatgtccgaatttattgcaaaccggaacactccgatactgccactgaaaatttatttcatgctatccgtttattttttctttttattgctcaaaaaaacggattatttgcgattcattctgcctctcttttgtatcatcaaaaagcatggctgttctctggtcattccggagttggaaaatctacacatactgctttttggaacacactttttcaaactccatatttaaatggcgacttaaatcttttaggttttgatatcaaaaaaaagcagattatggtttatggaattccctggtgtggaacttccgggattttcactgcacaaaattatgaacttggtggaattgttcttctcgggcagcatccatctaaaaatcattttgaagatttaaatgaatcagaacagattcttcgggtgatgcagagaatgatttctccggtctggaaagaacaacagctttctttgaatttgatgtttgctgaagaaattgtttcccatgtgcctgtattttcttttctatgtatgccagagccttcttctgcacaaagcttaaaagcaggaattaacctttgggaggataaccatttgacatgaaagaaaaaatttctcttatatggaaacacttcaagcagggttctttacaaaaaatatggcttcagaccttatggatttatcaatacggaaaacattattggaaatctatgcttatctatactttacttgggcttaccggaaccgtggtttccctcatctccagtctgatctccaaggatttggtagatattattaccggtcatcaaaccggaaaattagtaagcacctttattgcaatgattagcttttctatcatcagcattctgatttctcaggcttccagctacgcatctaccttcattaatctaaaagtagatactgagattaaaaatgacattttctccaaaatgctcgttacagactgggaagctttgaccaaatatcataccggagatctggtaactcgctggagtgccgatgcttcaaatatttcaagtggagttttaaactggattccaaatctgatcatctacgtctttcgttttctcagtgcactggctattgtgctttactatgatccgacttttgcactgtttgctttgattggaattccatttagtgccctgctttcgcgaccgttattaaaacgaatgaaacaaaacaaccagcgcagtgccgcaatgaatgccaaactctatggctttaaccaggaaagtttttcaaacattcaaacaattaaggcctttgacttgattcatttttataccaataaattaaaatcactgcaacaggattatatttccatgcgcctggattttcagaaaatgtccatgctgacttctatcttaatgtctatcatcggatttattgtatcttatagttgctatggttggggaatttatcgtgtgtggagtcaggcaatcagttatggaacaatgaccatgtttttatcgctctccagcaccttaacggcttctgtaaattcattggttggcttaattccctctgcaatctctttgactatctctgccggtcgtcttatggatatcgtagagatgccacaagaagaccatagccaagacactctggtaactgagtttgaagcgcagcacaaattggaaggcatcggacttgaactaaaagaattaaactacgcttatcataccggtacagaagttttcttgaatgccaatttaaacgcttacccacatgaaatcatagcgttagtcggtccttccggagaaggaaagacgaccatgctccgattgctgctctctctgcttaagccacaaaacggagacctttcggtatgttccggagcaaattttagtaaaaaaatttcattgtctccttccactcggaaattattttcctatgtgccacaaggaaatactatgttttccggtaccattgctgaaaatatgcggattgtaaaaccggaagctaccgatgcagaaatcatagaagcgctaaaacttgcctgtgcctgggaatttgttgcgaaattgccggatggaatccaaagtgagataaaagaacgaggcggtggactttcagaaggccaggcacagcgtctttcgatcgcacgcgcattacttcgaaaatctccgattttgcttttagatgaggcaacttctgcacttgacgttgccaccgagcgaaatgtattaaaaaatatcatgcaggatacttatcccagaacctgtattgtcacgacacatagaccaacggtattaaatatctgtaccagggtttatgcaattcgggagaaaaaatgtgagtgcttagccgaatcagaaattcaaaaactgatagccgaattttaaaaaaacctctgccgctgtgaacaacatagcgacagaggtttttttattaatttattagtttacagaataagtaaagctttccatcttaagatcatcaatgctggttccatgatcaatatgaattccaattgtaagtggatttgatgcagtacttgcaaaagttaaagtagcggtacttccattccatgcgcactgtactgatgcatcgtctgtctcaacctgatctacggtatcattaaacttaatgtttaaagtgatggttccatcaattccggaccagtctgccatagccaaactttttccgccatttgtaccccatctgtcccatactccataataagttacatttaatgtgccctgtgttgctccacttgctgcataaatcccttctgccattccactgtccactgtaattaccggcttttcgtatgctctcatttgtatctcctcctttaaaactatacttactaagttaagatttgtttttttattatcatattcatatattatccaaaagtcaagaattttttaataagatttattgtactttgtgactgtcaatgctataattacaaaaataattgtaccttatttagacaggagaaattatggaacctaaaattgatctcgaaaaattactaaatgacggtgctatcatccgcatcaagcctcagggctatagcatgtatcctttatttattcccggtcgtgatgaagcgctgattcaacaagtcccgattggatatttgcagcgaaatgatgtcgtgctctatcgcagagcacatagcattcttgttctgcaccgaatttatgctgtcactcctgctggtttttttatggttggagacaatcaatctgagcttgaaggtccaattcagccggaacagatcaagggaaagctgattgcttttattcataatggaaaagaaatctctgttgacaatattctttatcaaatcctttcttttttatggctctggctgcttccaatccgcccgttttgcttcaaattaagcgcttttttgcgaaagctaaagcagaatctctttcgcttttaacagctgcacgactgcttctacatcttcgtagacttcatccggcgttactttatactcttttgccactaacagagccagttgctctatggtctctgcttcttcggcatgctcatagataaaaccagcggtttcactaagtgaaaggacttcatgcactgcttctgtcttttctccgacaggcagaagaatccattcatcttccagttgcttcatcagatatccatttgattttttcatatcaggtttccttttcttagatttatgctataacatttttatttcaggagtttatttttatgaaacaagtataccatacctatttaagtattatcaaaaaaaattgcaccgactccgagtgcaagattgtagttccaaaagaagaatattctcaattaatagaattggcaaagaaacagtgtacgcttccgtttctcttgccttactttcgtgatacgccttattttctgttcttgaaacaacagacgaaacagattttactaaactattatgagctggaacattttaccagaaaaacggtttcattactttcacaaaatcagatttcctgctatctcttaaaaggtctaagccttgccgcttattatccggttccggagtatcgcaaatcaggggatgtggatttatatatcaatgattccgaaacctttgagaaagcgaaatctctgctgatttctcacggatatgtcttacaagatgaactcagtgaccaccatatgctttttttatacacgtttccaaagaccgggcgccaatttgaactggaactgcattatcgcattgtcgggttatatcaatatgaacaagccaaccaaatcgtggaggaagtattttccaatccacctaagctgacacaaacactctatggatactcctatacggtgcttgccccgactgaatctgcattttatctgattcatcacatgttaaagcactatctgtacagtggtttcggaatccggctgctctgtgattttaccgtttatttaaaccatttttataatgaaattgattttgagaaactgcatgcctggtgccgagaatccagaatttttcatctttatgaaatcattttagcgtgttgtcaaaattatctcggacttgcagagcaaattgatccggaagttacttatgatactgacgcctgcgaacactttctttcgatgattttagaaggaggagatatgggtacgaatgcgaatcatgcgattgtcggatccacctcttatcaaaaaataaattggttgacgtattttaaagaaggccatctgcaaatgaaagtacgctttccaaatgcctcccatctccctgttttatggccatttttatggttctggacctttgtctgctttcttaaaaataatcgaaaacttcgaaacacaacatttcgggcagtccttcgagagtttaaagaaaaaaatgaacacaccaggcttatccgtatctttgaaaacagcgactcttaataatgagccgctgttttattcttttattttatcctccacaactttgtagccttcaccgattttatttacaatcggatcatatccaagtactgcttttagtttctttcgaagtgatgacatatgaactcgaattgaaccactaaaactatccgcagacgcatcccagacatgttcaattaattcctcctgactaaccggtctgccttgattcaaaagcaggtattctaagattccattttcttttcgggtcagcgccacaaattcgccattggcataggcttcccgcttttttgtatcgaactttatgcctccgcaagtcaggcacacatctttttgcacaaacttacggcgggtcaggcttcggatacgagcctctaattcttgtaaatgaaatggcttttccatatagtcatttgcaccggcatccagcccttcaactttatctgctatctgacttcttgccgataaaatcagaacctttgtttcctcattttttttgcgtaattcttttaaaagctccattccatccatccccggcaaattcaggtcgagcacaatcaaatcatagttttctgccaatatataatccagtgcttcgctgccgtcataacaggtatcgacttcatagccgacgtgatacaaagttttggcaaccgtatcacataactctttttcatcttcaacaattaataatctcacggtattttccccatttccttaacagaaattttacaccctctattgtataatacttatgtcgacaggtcaacaaagacaaatttggtcaaaagaaaggagcaatcaatttttgaagagcaaacaaatactacaacttatcttacttgctgccggtattattctggtgacgtatgggatatccagaggagaagcggctgttgtacttagcaaagcaattaaattatgtctggagtgtgtaggaattggataagaaaacaaaactcaaatcaaagaaaatcgcaggcttgcgtggttggattcaggcggtcgccaccttgcttacaaatatacatattcctaatttatttaagggaaaaatctatcagggggctgccaaaaatgtctgtgtaccgggactaaattgctattcgtgtccggcagctaccggagcctgtccaatcggagctgtgcaggcagtgattggttcctcaaaatttaaatttacttattacatcaccggattttttattttgctgggtgtactgcttggaagatttatctgtggattcttgtgcccgtttggatggtttcaggatttacttcataaaatcccgtgcaaaaagttttctaccgcaaagcttaagccattaagatatctgaaatatttcatcttaatcgtgtttgtcatcctgcttccgatgcttgtgacaaattcaattggaatgggcgatccgttcttttgtaaatatctttgtccgcaaggcgtgttggaaggtgccattccattagcaatcggaaacacagcaattcgctcggcacttggcagcttgtttcgatttaagagtattatcttaattacggtggttgtcttaagcattttattttaccggccattttgtaaatggatttgcccactgggtgcaatttattctttatttaataaagtatccttgcttagcataaaagtaaaagaggatcaatgtattggttgccataagtgtactactgcatgtaaaatggatgtggatgtgctaaaaaatccaaatcatccagagtgtatccggtgtggcgcctgcatgaaagcatgtccaaaagatgccatttgctttcaatttatgaaaaaccaaaaataaaacatatatctataaaggagagtttaaccatgaaaacaagaaaaaatattattaccattctcacactttgcgcagccttatcactgactgcatgcagcggaaaagacactactgaaaagaatcctaagaagaacgaaagtactacctccgatacaaaagagtcaacggatgcttccactaaaaaattagatgatctctatcagcaggaaaatcagatttttgcggatcatagcgaagtatgggataaagtatttggcatgatgagcaagacaaatacagattccgatagtgcctatgcagatttccttaccgcaaccattgaagaaaataaatcttcttttacagaggatgaactcaagacattagagagcgacattgaaaccattcgaggaattgaagaacagatttccaagctggaagatgaactggcaacaaccggctctgcggatacagaagatgctgctgatgaggatactccatttaaagatctttccggaacagacttcgacggaaataaagtggatggaactctgttttccaacaatgccgtaaccgttttaaatttctggtttacaggctgtaaaccttgtgttgcagaattatccaaactcaatgaaatgaatgaagcaatcaaatctatgggcggagaagtcgtaggaatcaacactgaaactttcgattcaaatgaatctgcaattgaagatgccaaaaaagtgctggaaagccagggcgcaacttaccgtaacctttctattgcatctgattccaatgcaggaaaatatgcttccgaaattatggcatttcctaccacgattcttgtagatcgaaacggaaagattgtaggcgatccaatgcttggcggaatcgatgatccggataattatgatacgcttatgagccagattcaatccgtgattgatgcagacagtgcaaataagtaagtaaaaaatcatgaaaaaattatcaatccaatggcgacttacaatcatcactacattattcattgcattaatctgcggatgccttacgttatttatctataaaagcggagtttactacattgattctctgcaagatacggtaaatgcccaaaatgaagacgacagcaaagacggctcggaggaaatctatatcagcatcccagatgaaaaatggcaagattttgcaaatgatttttccattcaagtttacaataacaaagcagattataggaaaacaagtctgattctttccgcactgatggcgcttttgggcggtattattaccttttttataagcggacatgcgctaaagcccctcagtgaattttcggataaaatcgaaaaagtacaggcacaaaacctggcagcttcacgaattgaggaaaacaaagtcaaagaactcaatcaactgagtatttcctataataagatgcttgaacgactctctgagtcctttgaaacccaacgccaatttaccgcaaatgccgcgcatgagcttcgtactcccctggctgtcatgcaggtacaacttgatttgtataacgctaccgaacatccggataatgatgagtgttctcaaaaaacgctcaaaatggtgaccgaacaaaatgaacgactcagcaaaatggtaaaaacccttctggatatgagtgaactgcagaccgtggcacgcaacgaagaaattgcactcgatgcactcgtcgaagaagtcctcgcagatttagagccgcttgcccagaagaaaggcatcacccttaccggaaactgtgaagcccttactatgacaggcagcgacatcttaatctaccgacttgtttataatcttgtagaaaatgcgataaaatacaatcgctcggatggtcaagttaccgtaaccgtagcaaaaaaagaccaaaacatcattttatcggttgcggataccggaaatgggattcctgaagcactcaaagacaaaatctttgaaccgttctttcgcattgataaatcccgaagccgtgcacttggcggtgtcggacttggtcttgcacttgtgtatgaaattgtaagagtccataatagcaatattactgtcaaagacaatcctgcgggtggtacaatttttgaaattgttttttaaacatgcaaatttttttgcatctcttctttaaactctctgcctttaaacaacagcacgcctactaaaaataaaaagcacgccaatgcaccaaacatactcacagttgggcgcttcaccactttgcaaaaaagcaggatgcccggaataatcagcccgtatccggcagccataatttcatagatcagatactctcttaccgggcttttctgcactcttgcaatcacacacattgcaagcagaattcctacactcatcagcggcagcacaaaatcgaccgaccagctatgccatccggttaatgcatcccagataaagctaatgatggttccgattaacagctgccacatcaaattttttaataaattgtagcgtttaaagaagccaattgacgaggcaatccacattgttgcaacgcctccggcggtaaacagtgtccaacgaatcttcggatggaaatttaagtcggtcaccaacatcaatgccactagtgcaatacataaaaaactataaattttatagactttcatctcctgctcacttggcatcgttggcttcggaaagaccggctctactttttgggctgaaattccctgctcttttaataagcgataaaaattgcgttcaatattttcggtatcatatctggaggtaaatgcaaaggacaatttatcttgaaatgaacacagacataattccattttcggagtgtttgtatacacaccaaatcgctcaatataaggcacatagcttttgggcattttaaccgcactcatattagaaaaaattgcggttacatttttttctgaaaattttgctcctgcctgaatacagagattcttaagttccagcggtgcgagccgcaaaatcgggtgtagttctaatgcaagtaattcactgatatgtgccgacattttttctttggtcaactcagcttcaaaaaaggctttcgtgtgattcaatactgcttcaaagcttccatcttgcgttgcaaaatcatatcccggttcaatccagttaaagaaatttaacatcgacgtcgatggaaaaaattttcttaaatttaccggtaccattaatatcacagaacgttttttctgcatcttcgacatttcttcgtgaatagccatcatatagattgccgtcaaaaagatggtcatagaaacaccaagctccctgcttctttttaagattgcctgtaccgaaacaatagattcatggacatgcagacggtttccatctttcttttttctacgtatctgaaatgcatgcagcttcctttttttcggtcgtttttggtcttttgaataatatttcaggaaactatcatcttcctgatcctgcactgtcatatcttccggctgcagggaaacctgctccagtccctcttctttatgcgcaagatacagatagtttttcaccaattcttttaaaaattcagttgctccggtgccatcggtcagtacatgaaacacttcaaaattaatgcgtttttgataatacgtcacttcaaacagcagggtctttttgtctctgatataaagcctgctgcaaggctctttatactcttcttttacaaccggacgtaaattacaaggctcaagataatgccaaaacagaccttttcgaagtaccataagaaaagtcggaaaagtttctaatgtctgatccagcgcttcttgcaaaagctcagactgcacttgctcttttaattcacaataaaatcgaaagactcttgtatcttttttattactggccgcagaatataattttgctgcattatccagttttctccaatgtgcttttttttgcttcacgatgcttcccctttcaaaaattcattgatgtaggtgaaactttcctgcacatgcagctgcttgattcccaatgcgaaatagccgtgaagggcatctttaatccgatgaatctgtacccggttgcccgcttcttttaagcgttttccatacgcttctccctcatcccgaagtggatcaaattctgaggtaagaatcaatgtatccggctgattacttaaatcttttgccagatatggtgcaaaatatgggttctttttatcttcctcatttctcgcatagaggtcaatataatcctgcatttttcctgctgtcaaaagataatccgttccattttcttttacagaggcaaatggcgatttttcggtataatcgttatacgtagcaggataaattaaaatttgtctgctcggcataaactcttttcggtctcttgccatcaaagataatgcagcgcaaaggtttccgcctgcgctgtctccaatcagtgtaatgttttccggctttacatttaatacaaactgaccggaatataacgcctttgcaactgcataacaatcctccagccctgccggaaatttatcttccggtgccaatctgtattctacagaaacaacatactgtccggttgcatctgcaagtcgtgcacagattctttcatagttgtcaatactctctgtcacccagccaccgccatgtataaataaaagcagctttcgctcttgactgtccgcttttttttcttcactttcccgaaaacttttttcatttggaaagaaaatacgaaccggtactgcatggctcccgttatatattttttcatctacttttttataaaaaattttcattggatccaatcgctttaaatccgccatatgacgaaacatttctacttctacaccatcaaaagaaagtgcttttaaaattttctttgccgcttgattgatcaatattttttactcctttttatgcataaattttatattgattaagttttagtatagcacaaagcgccatgaatgctctagggtttttcctctttctaacttttaattatttggatgcactcaaaacactacttccgtatctctggcatacgcatttgaaacaatctccattggcactctctccagccaatcttcgccccactcttcacgcttttccaacacaatcatccgtcctgtttccgtaagcactctggctaagcgatcttccgatgctgttagtgacggtttatttcctgaataataacccgccgttgaactaggtgtctttccatacttttctgcaaaacaagagacttcctttgcagttaccattcctccggctctgtaaatttcttcaagtactgccactcttcttatctctgcaagtgtcgcagttactgtgttatgttcagcttcaagccgcgcaattattgcagatagctttgcctgcatttcttttaattcgtcgagtaaactttgcatgattttcgtttcctttcgtatttcatccttcaaaccgttctttcatactttatatgaataccctatcacagctcgactgctttgtcaattcattgttttattcattctttggttatcataatgaatttttgcaaaaaaacagtttgcgttaacagaaaacactcctgttaaaacaaactgtttttaaaagtgctgcaacgaccaatagagcgaatcacttcattctactcttcatcattttgttttttacaggttccttccatctttgcaatttcttctgtggtatattcctctacttttgtctttgttactgattttatatgttgctttttcaatctcgaatatacaaattcgcggaaaatcgtatacaatacagataccaaaggaataaacacaagcattcctacaattcccataagatttccaccaattgtaactgctgcaagtacccagattgatggaagtcctacagacccacccacaacatgtggataaatcagattgccttcaatttgctgtaaaacaagaaatacaacaataaacaaaattgcctgtttgggactcaccataaaaatcaaaaaacatcccattacgcacccgataaatgccccaaaaacagggattaatgcagtaaatgcaattaagactccaattaaaagtgcatatggcattttcaaaatacttaatgtaatgacaaacatacttccgagaatcacagcttccacacactgtccagtaaggaaattggcaaatgtgcgataagtcagggaacaaatatcaagaaacatcgtcgctttttgtttcggaataaaagcgaaaaaaatctttcttatctgtacatgtaatttctctttttgaaaaagaatataacaggcaaaagaaaaggcaataaagaaagttgcaaatccactaacaagggagcctactgctgacattgtcgtattcatcatattgcctgctccgtttccaagaacgctgattccccacttaattgctttatcagaatcaaattgcacctgatttaccaggctcataatttcctgattatcattggaaaactttcgaatccactcttgcatctgcggaataaaatcagcaatacttgccattaagtttcccattgttcgcgtaagttgcggaattacaccaaacaacactaacagaatcacactaagcactaatataatggtaagcagcagactgactggtcttgcaaactttccccctgcctgttttcctgcttctgctttcccaaaaattttctgttctaaaaaactcattggtacattgatcacaaatgcaatcgctccaccaagagcaaaggggaatacaattccccatagctcttttattacgtggattactacatcgaacttccataatgcaacaacaagaagtacagtaaatgcaatcaattcccgaatttttttaatattcattttatttaaatccattattattctccattttttcttaattttatgcgtacccatttaagaaattgaataatcggaaggctgacaaacgcatacagatataccaaaccaagttgaatccaattcaaagtttctactttaaatattatatgaagttccggaatcatcaatactgcagtaataagtgctgcaccaagtaaaaatgctccctgaagccatttattattaaaacagcgttttgtaaagagaaccggatgatctgatttacagttaaatccatggaacaaacgtgccaggcagagtgttccaaacgcatatgtacttccgagtaacgcaccgttttgatgatagcctgtcaaaaatccaatcatcgtcattgcaccaattaccaaaccttccagaccgactttaccaagaaaatcttttgtcagtattgactcatctgcggatcttggtttttcattcatcacttcttggttatgtggttccattcctaatgcgattgccggaagactatccgtcaaaagattaataaacaatagatgcaccggtgcaaatggaaccggaagccctgccagtgatgcacaaagcaccgttaaaattgctccgaagttacctgataaaagaaattgaatcgcagacttgatgtttcgatataaatttcgtccattctccactgcttttacaattgttgcaaagttatcatctgtaagcaccattgccgctgcatctttggcaacttctgttccggttactcccatcgcaacaccaatatttgcctgtttcaatgccggagcatcatttacaccatctcctgtcatcgccacaatcattcctttttcctgccatgcacgaacaatgcgaattttatgttccggtgatactcttgcatatacagaaatattcggaacaaactctcttaactgctcatcactcatattttcaatctctgcaccttcacaagcttccgataaatcatgcaatattccaattctttttgcgattgctgccgccgttattttatgatctcctgtaatcataaccggacggattcctgcttttatgcactcttcaactgccgcttttgattcctctctcggcggatccatcatagcaattaatccaagaaatactaaatgattttcatcttctatcgttagtttatgctggtcaggaatttcacgataggtaaatgccaacactcgtaatccttccatcgaaaactcctggttttgttgccggattttttctttttcttcttccgtaagttctcgaaccccagcttttgtccaaattcgttctgttcgttctaaaagccgatcaacggctccttttacaatcattcgattttcaccgtcaatttgatgcaaggttgacatcattttacgctcactatcaaatggaagttctccttttcttggataaagtgttcttacacttgcagcttcaaccccatatcgacttcctaaattaattaacgcagtttctgtaggatctccgatttccaccccattttcatttgttgaatcattacataaaatactatcgtccaaaagtcgtctttgagccaggtctgttatatcaattttacttgctgaaatccgttttccatctatataataatcttccacagtcattttattctgagttagtgttccggttttgtccgaacagataatagaaacacttccaagaccttccactgcctgaagtttacgaataattgcatgctcttttgccattttttgtgttccaaaagaaagcacaattgtcacaatcgaactcaacgcttccggaatcgccgcaactgcaagcgccactgcaaacataaacgcactgctgatttcttcaccacgaaatacgctgactgcaaatagaattccacaaaatattaaaattaaaatagaaagtttttttccaaatttttctaaactcatctgaagaggagtttgtttttccgaagtggatttcaaaagccccgcaatctttccgacttcagtctgcattcctatctcagtaacaactgcttttcctcgcccatatgttacaaagctaccggaaaataacatatttgttcgatcgccaagtgatgctttctccaaaatagtatccatacttttttcaactgcaaggctttctccggtaagcgcactttcatcaaccttaaggcttgcattctcaattaatcttccatctgcaggaaccatatctcctgcctcaagtaaaattacatctcctacaactaactctcttgccggaagttgaatggctgtcccatcacgcaatacttttgcctctggtccggaaagcttcttcaagctctgtaacgattgttccgcctttactgtctgtattgttcctaaaattgcattaaccgtaatcactgtcacaattactgcggcgctctctacatctccaagcatacctgatatgactgctgatgcaattaaaataagtaccaaaaaatctttatactgttcaaagaaaatttgaacaatattttttttcttgccttctgcaagctcattccaaccacatttttctctagactttcttgcctgctcacttgtaagtcctaattctttactacctacctgtttaaggacttcttctactgtttgttgataaatttctttcattacgtttcagcctcctctgtttactaatgtactctgcttattatgcaatgaaagactctttcgataaaaatgtataaaaaaagaaaccattattgcataacaaaaaatgcaataaaagtctcaccatttttttgtggcaccggatgtctccatcgtactgacgataccacaaacgctatttacaacgtaggttactcccctttattagtactaatcatatactaaaaatgctcccctgtcaatataaaagattaacagacaccctaattcatgctaaaataaaactaacaaatacacaaaagtaggaggtatccattatgaaagaatcatttgtgcacgtatacaccgggaatggcaaaggaaaaagtacagcggcgtttggtttggctttaagagccttgtttgccggaaagaaagtgtatattgcccagtttatcaaagacatgaaataccacgaaaccggcatagaaactgtaatggacggcatcaaaatcgaacagcttggggctggctgtttcattgaccgaaaacctaatgaacatgatagagaagtcgcaactgcagctttacaaaaatgcggaaaaattttggaatccggcaagtttgatgtggtgattttagatgagattacaatcgccctatatttcaaattattttccagtgaagacgtaattaaaattttgcaaagtcgaaacccaaaagtagaagtcgtcctcactggaagatatgcaccgcaggagcttattgattacgcagatttggttacggaaatgcgtgaagtcaagcactattatactcagggtgttctatccagagatggtattgatgtgtaacaaatcgcaaaatcatcaatcctattcataaactatttcagttcgcaggtaaaatgctggcgcagctgtgccggattttcacactccttgccaaaatcaataaaactgcgtccgctgtgaactgcaatatacagcctgcctccaaagttgagatttataatgctctaaacacctgagcaaaaacagtgggaagcaattacagccagctttccagaacatcattcagcttattcatatccagcggttttgcgatatgtccattcatgcctgtatttttgtcaagctgtacgtcttctgcaaaagcattggcagtcatggcaacaataggcagttttcccttttcacccggaagactcctgattgccgctgttgcctcataaccattcataacaggcatttggatatccataaaaataagatcatacgaacctttcggagaagcttccattttctcaactgcaattttcccattttctgccgtttccacttttgcacctgtcatctgcaaaatttcaccagcaatttctctgttcaactcattatcctcaaccagcagaatccttttttccgtgtagtctgattttgacagcttctccaaataatttcttgctgttttttcttttcttcctgaagtaaactgccgcagtgtagccgtcagccgagaacggaacagcggttttgcaataaaagcatctatgcccgccgtctttgcttcttcttcaatctcgctgaattcataagatgtcaatacaatgatggtgatctcttttcctatccgtttccggatctgtctggcagtctctataccatccatatccggcatcttccagtctaaaataacagcaaagtaatcatctttcaactcatgccgtgcataacagtgctcaaccgcttccctgccagagagaacccattcacccataataccgatttccttcagtgtggcaactgtactttcacagcatgtcttatcatcatccactaccagaaccggcagattcatcagatttttgtcctgttctttttctttttcctgaagctccagataaattgttactgtgattttagttcccttgtgcaagatactatccactttaatagtgccattcatcaggttcacaatatttctgctgattgccattcccagaccggttccctggactctggttgtccggtggtcatccgcgcgactgaacggatcaaacatgattttctggaattccggtgacataccgatcccattatcctcaatcgtaaattcataacatccaagttctgaaaatccatttgacttttcctctatggaaaaaataatattcccgccatccggtgtatacttgatcgcattactcatcagattcacaaatacctgctgaatcctcaagctgtcaccacagacagcctcatgttcaatatgattgatgtgtatatcaaaattatgttgatgttcatcaagcagcggtttcgtaagtgtaataagattatctaccagctctgacaaattgaaatcttcctgtgccagtgtcatttttccactttcaatacgtgccatatccaatacttcattgatcagccccagcagatggcggcttgattctgtgatcttgccgaggcattcaatgactctgtcctggctctcaacatttgctcctgcgattgccgtcagacccacaatcgcattcattggtgtccggatatcatgggacatattgttaaggaattctgttttcgcacgatttgcattttctgcggaccggtaagcctctttcagcgcctgacgagattcaatctctgctttcttctcctgcgtcacatccatggatgccagcaatacttttaccagttttccattctcccattctaacggaatataagaagcgattttataagtcttttcatcccggctgcagtactcaaacttataaatatcattttcacctttcagattcttccggatattatccgaagttatcaggatatccatagcctgcagtggttccagcgtcttatacttttcaagaacctgcatctgaaaatcatgataaaagcccagaggtttatataccatctgcccattcaggttgtaaaattcatatctgtcattttccagatcacagacaacaaagcggtcaaccagacgcacaatactctgaatcagctgctccatggaagcattatccgctgccatctgcagatgccgtgcgctctctacctttgcctctgtgatatcacgcagaaagatcatggcatattctgaatcctctatttcgccacgtatgaccacattgcggacccatcgttcttttccattcagagtgatacggcactctaaagccaattcggtttccagacccttcagcctttctgcaatataaccacggtcgtaaaaagaggataccgccttcttatctgtctccacaacataggaatccacaaaatgccgaatcaattcatcccacgtatgactctgttcaaagacggtcatcagggacggttcaaccttaaaggtatcaaaagtattcgcttccagattcacataatactcgcacaaatctgctttcgtaaaagcccggtggaaagcagcagatttttgtgcctgcatgatttcttttttctccccatcaatgttaataaaaatcccggcaatcctgctagcagaaccatccagacggcgtattacttctgccgatgcccgaaaccactggtattgattatccttcattctcatacgatactctacctggtattttatctggttcgtcttatccttaattgccgcctgaagctgcaccatgactctttctttatcctgtggatgcagaagatctgaccaggattccagtttattcggaaagtccagagtgtcatgatagccaagcatttttcggaattcatgactccagtttgcattcacaatctcactgttttcgtcacagtcaaaataccagaagccggaacagatagcctcattgagcagtgccagatttacatgatcccagttgacctgtacggacataacccagatctgtctgcccgcctcatctgtcgcatcctctttacaaagccgtacattattcactgtaccatctgctgcaaggatctgtgcttcccctgttccgtgaagctgcaaaaaacggtcctgatccagtatctctataccatctccataaaagaagtttttcaatgaacctttcgtctgcttcataaaagaatcaaaggtataccctgtactatgtaacagcagattgctcacagacaaaatagacaggttttggtcataatatcctgtcattatacctactccgccattattttccagtgttttctgtactacctgtgacatagcccgtgtttgtcccgatacagtctcacttaaagaatatattttatcttcataatttcccattttataaaaatcctcacttcgttttatacctttttcatcctgcttcaatctgcctattgaaaattttcttgctgtctaatgatttctgataatgtcgacagcaacttatcaacttggattggctttgctatatgaccattcattccagccgcaagagccgctttcttatcttcttcaaatgcatttgccgtcattgcaatgattggtatacacgttttagctttatctggcagatgtctaatttcctgtgttgctttataaccgtccattttgggcatctgaatatccataagcaccatatcgtacgtacccaccggcatttccattatcctgtttatacactgaatgccattctccacacgttctgttttaagaccggcacgctccagtattatttctgcaatctccgcattcaaatcattgtcctctgctaaaaggacattcctgcctttcaggatcccactacctgtttcttggttttcaacatatttttttgcataatagcttttatccgctatcttgtgctttagtgtaactataaagacgcttccctttccaagctcactttctacatttattgttccaccaagcagagcaacatatttttttacgattgacattcccagtccggttcctgtgattttgctctttgtggtgttctgttcccgtgtgaacggctcaaaaatctttgtcagataatcctgactcataccgattccggtatcgctcacccgagttcttactattatgtatcctgactcatcgcatggtaattcctctacgtttaccgtaacaaaaccgccggataaagtatatttcatggcattgctcatgatattaacaaatatttcctctatcttggtaacgtctgtcaatatgtgcttatgctctacatccaccttgtaatgaaatacaatattcttcttctttgcttcatcctcaaatagttcaaacaaattctgccagatagcttcaatctgggcataattctcatcaatctccatccttccgctctcaatccgagccatatcaagtacattgtttatgattgacaaaaggattctgccggactgttgcagtttttccagatgttttgaagtttcggtcagttcttttccttttagttcatcctccataagctgtgcatagcccagaattgcattcataggagtacggatgtcatgcgacatattgttaagaaaatttgtctttgcaagactggcattttctgcttttttcagagcaatttccagcttatcattgagtttttgtgtattatttgccgcaagctttgcgacagtttccgctttttttgcctttcttaaaagtacgagaataatgccaattatactaaaggaagaaaaacctatggtgacaaaaacaacaagcagattgtcttttacaaagtcagaaaatgtcaccttacctgccgtactgtcataaatagcaattgcacttgtaagcatatcagacggcatggcctttaaagttttattcagtatcgacaaaagagctgcctctccacttcttatcgcaaagcatgcctccattgtttttgtaagtggaacacttttgaaactccggctgttatcatatatcatcgcctgacttgctcccatgaggaaacagtctgctttttcaccggaaaccatatttgcagcatcctcaagcgaatcacaatctacaagcttccattgtggataactgaacgcaatatgctgttttaaggcatctttttccttttgcacagctactgtatacacattattttcatcaaactttttctcatctgttaccgccatcagactgtaagtccacgctgtatttgtaagtgcatatcctttttcttctgcaaaatcaggatttctgctggtataaaaaataatatcaatttcatgttcctgtagcgcctgagtcatttcgtcataattatcatacgacttcatattaaactccagtgtctgatcattcaggcaatcttttgcataagagatatattctgacagcatgccggtaagttttccagtctcttcatccatagaaaagattgccggatcattgtttaaaaatcctacccagatatcaccatgttcttccagataggacttttcttcacctgtaagaatctgattataatcaagagtaaaatacttcttatacagatctgcctgaaaaaaaggactatcttgagccaactgacgcatagcccagtccagttccgtcttgacatcgctgcgctctttgttcattacaaaatatatacctgatttaccaatattggtaacagatgatattccctgttcagaccagatggattcctccaaagatataaaacagtctatctcatgatttgctaatttcttttcaacatcatcattattatacacatttatatgttctgtatttatgccgttcttatcttcccactctgtcagcatgatttcaggttctgtacccatgagcacacctacacgtttcccatccagagacttaaaatcagaagtcacaatatccgtatttgacaaatcagcataaagaatatatttttcctctcccatcggttcctcggaaaaaagcatcttttctgtacgttcatcggtgtaagagatatcacccataatatcaatctcacccttttcaagcatgtcaaaacagtttgaccagtcacatttcacatactcaaatttccatccggtatagcttgccagagcctgcatgagttcgtagccaaatcctcgtctgacaccgtttttatcaatataattaaaggtatcctcaaacgaaccgacacggatgatcttctgctcttttgcctgcatgtctgatttttttgtttcctgttgcgttgaattatcctgctttgccatctgtagctgttctttatcattatctgtttcagcagcccagcaatgtactgataacatcatccacattcctaaaaccacaagtatacctatacataatacgactaatctttttctacttttgtacattgctcttttctccacaatttaccaggttattacccagcactgattttctatttatcgttttccctacctttttcatcattatatcttgtattgttaacttcggtcaacaatgcactcttatttttgtcttttttgtggatatcattaaatttaatttaacctcaacagattcattaccaattttaccattacatctttttcttccgcttttgattcagcaatcattaatgtaattgctactaacgttccatcactgagtctcttctctccatcctgaaacagcgcattgttcttgtctaaaaattccaggaacagtgatgcggcaattcttttacagccatctgcgtatggatgatcttttatcataaaatacaataaatttgccgctttctcttccaaagacggatacgcatcttgtccaaatacactttggtaaactgcagcaataattccttctaccttaccggtctctttttccacaccaaatacatctgtttcaaaagaatccttcatctgtccaaccatctgaacacaatcttcataagtaatgcggtatatcggagtacttccctctggcttacttaatgcctggtggtcatattgatccagaagaatcaatgcatccgtgtattcatttatagctctgagcacatttttttcttctatgtcaagtgcatccacaagcatccttgactgaatatcaactgttttcctaagtgcctgaagatgattttcattgagcgcatagcctttcaaaataaactgtttaagaacactattgacccattttctgaaagcgatacctcttttggaatgaactcgataccctacagacaaaatcatatccaaattataaatcttaggttttcttccccccgtacttctgtcggaaaagccgacagaagtctcatccaattctcctgaagcaagaatatttgagatatgtttgcttactgtagcgcgcttaacctcaaacaacgcttccatttgtttttgagtcagccagacagtctcttgctcaggattaatttgaacttctatattaacatcaccatctgtaaataatacaatttcactcttcatcttttcgttcctttccatgaatatttcacgctgacttttccaaaccccattttcagtcagactactttttatcctttgatttataaatgagtagtgaaaacccataggcaaacctatgggttttcactactcatttatcttttttcattctttcactccgcccgtttttaagtattcatccgcatttttacatattttattaaatacttctgtacatatgcgcctttcttcttgggttagtccctgcaagaccgtttttacaaactcattctgcactttaattccatcttctatgatcggaatagctgcctccaataaaacaatctcgatatgcttcttattgtcagtgctttggactcgctttaccaggtctctgctttcaagatttttcaaggaagaggacacatgagattttgtggatttgcggattttgacaatctccgctgccgtattatgccgtggattgttatgcaaaaatatcagtatgtcatattccatctgtgttaactggtatttctcacatacttttcttgaaagcatttcataacaacttgagattgtcttatgttgatcccaaaaaaacatagcgtttctccttcctttcacttcgttctatttagaacgattatatggtgtctatatccccttgtcaacccttacttataattttttccacgattttctgagtgccacataggaaatcagaaaatttgcaaaccagccagctggtacagcaagccagacaaatgagatgccaaaacgaggtgcacagagcaaagcaactgacagacggattgccaggtttaccatattcgcaatgagaaaaggctgcatgattccaagtccgcgaagaactccatccgttgccatcttgatacccataaaaataaaaaagcagccgagccatctcatataatccccggacacctgatatgccaaagcggttccatccttacccagaaataacgaggaaatttgagtatgcagtgtttcaatgattataaaagcaagaactgcaaaacacagatccaataccagtgcagcatgatacccttttttgatacgcttgggtttctttgcgccaagattctgggatacatacggtgagactgcatttccaatagatacaaagatcaatgaaaaaacattttccacccgcatcgttgctgaataaccagcgagtgcctgtgtaccaaatggatttacaactgcctgtacgatcatcataccaattgatactgtggactgttggagaattgatggcacggcgatttgaagcatagaatacaactcctgcccattaaaccaggcaaaatgacttttatatcggcgcatccgactaaagaaaatcaaaagcgaaaacactgcggaaatcccctgtgcaatgagagttgcaagggctgcgccgaacacacccagaccaagtccggccaccatccaaagatccataaatatattcaaaacagaagagaatatcaaaagacccaatggaatttttgactctccgatagatgtgaacatcgttgaaaggatattgtacataaacagaaacggaaagcctacaaaataaacgcgaagatacagcactgcttcatccagtatatcagctggtgtctgtaataagttcatcattgaacgggaaaagcaaaaaccaaaaacccccagaagcatacttagaatcagaaagctaatcaatgatgttgacacgattgttttcattttactataatctctggctccaaaataacggctcacaagcacacctgcgcccacaccggcacccaaggctatacaaatgaagacattcgtaagtgcagcgcaagcaccaactgccgcaagtgcagaagagccgacaaactgaccaacgataatagaatcagccatattatatacttgttgaaaaaagctgcctaaaatcataggcattgcaaaaacagtcaatgctttcagaggcgcatctgtgatcaaatattcatcctttgacattatcttattttctcctccatcagaattttttgtattttcgaaatgtaagttataagtttcgttatgtaataattatatgtagttacagtaactaagtcaagctatcatttactttttgtaatataaatggtatgatatttgatatgcaatggatattattttacaggagggacaattatgtacctagacggtttagatgaactggatcagaagattatccagttgcttatagaaaatgcacgtatctcttactctgatattggtgaaaaaaccggtatttccagagtagcagtaaaagcccgaattcaaagcttggagaaaaaaggtataatcgaagaatatacaacaataataaaccctcaaaaaattagtggtgctgtatcatgctattttgaaattgaaataaagccggaccatctatcgcaggtaacagatatattgtataaaaatgatacagttacacagatttaccgtgttacaggaagagacaaacttcatatacatgcagttgcttcgtcaagtgatgaaatggaatacttcctgtacaatgtcattgacacactgcctggcattatcaactgcagctgcaataccatcttatcacgcattaaagatattaaaggattacggctatgaattatatccaatttagacattgtatagcttaatcccgacattctcatgggatagtaaatttaaagaagtttctgtgggagtactaaacgaatttacaaggctcctcacacctccaaaggaagtggaaagagcctatgacaaacaaaaggattttatttatgaaataaacagccgttcctgatatcctgctctttttgaaatcccgccactccactatgcatatctccatcttttttcactgcctccacccgatacaacattacagaattcaaaacatcatccagcaaaattccggctgcaagaaaacttctctgtcttttataggccggaaaagtctctatttgccctattattaaatttcgtaattccaaatttctctgaatgatctgataaagaagtcttcctcacacagtgccttggtcaaatgcatgtggatttccagtcaccattgcagcaaaaactgccaggtatattttttgtgttttcctgtatggcagtttattaaatatttctgcggaaagctttaactgttgctccagttcttcaaaatcttccctggaatttcctttcagcatttgcatgaaatattccaactccacctgtgccggtgtcccctcatactcgctactcatgcgcagtagcaattcctgctgtttctgcgcctttaagattctttcttcctgtttgctacacagtgcttttccaaaatagctttccagaatctcttccggtgcaagtcctttatagcgactattttctaatactttttgaaatttttcagcagagattgtcacacttttttgccgatgaaaactttttccaaagaatccttccaattcttccagttcttccggcgataagctctgaacacgaacgctccctgaaaatcttccataagaagcatatttttcaaaaaaaccgttcagtaccttttcccatactgaattttgccgaaaatattctacacatttcttcagttgctcatatagaactatatttcaagattttctttgcatattcataaaaaagcgttataatcgaagcagttaaatcaaaggaggtatcaaatcatgaaatcacataaatactggtctctcggagcacttttctgtatgttgggatgcatttattctggaatcaaaaaatctatgactgcacataaatactttgcctattcttcattgctttgtatgggcatgtccatttattccggtcacaaactggtttctccaaagaagaaaaaaatcactgaatcaaacaatagtgaaaataattgaacaaaaaattgacctctattcatcaaagacaaaattgctggagattatttccctccagcaactttctttatctttaagccattaaaacacaatactgtccaatcagcttcgtccaactattatatttattcttttcacacacctttcggcaaatttcattttccatcaatacacaaaacatcttatcataatccaatgcccaaacagcaccattcacatggttctctactgctttctgatctatgcttttcaagcgtgtgaccattttttcaatttctccattttctaagttaccgatatttttgcagataaaccaaaagaaattcaacgttgcatattcgtcatgccaatggaactcttctggattgttttttattttactggctcgctgctgttctttgattatctgatcagctacacctttcatcgaatcttcgtatctcatattactcacctactcttcctcaacgcccagtgacggtttaaatcttttatcctttgcctgcggtaccacgatctcataaaaataaaatcctaaatacccaagtgcctgcttcttcattttataaaaagaagtcctacctattcctaattcctgctgtacttccacatccttcttattataatgactgcaaaaacaggaatgaaggatttcactgagcatcacaccattcggtgcatagaacttcaccagtgtcattccacgatagatcatatctgacaagccataaagagaacatgaaatatcatcgtggaaccagttggaaagccaagctacgtgttgccgtggataaggcaatctggtcttctgtcaattacaatgagtttttacagaaaatgcagttggctggatatgaagtccgacagggaaaacatctttctttccgtgcaccagagcaaaaaaatttcacatatatgaaattactggggagttattatacggaagaaaatgtccgtacccgtctggagaaaaaccgttataaaaccaaagcaccaaaacatctgtcccaagaggctcgactatatatcaatatttccacgtatgtcactaccggtaactgggaaggatttgaacgttgggcaaaactcaataatctgaaagaagcggcacgcaccttcaattatctttccgaaaataatctgctaaactacgaagactttcagcagcatatttccgatatggaaaattctgttaaagcggctgagcagcggattgaagaaatcagtgcagaactgggtactcagagactcatccaaaagcattgcgattcttatcgactctgccgtaaggtaattgaagattgcaaatctgctaaaaatccaaaagcataccgggtcaaacatcaaacagaataccaactgcacgattcactaaaaaaagagcttcaggatctgggcgttaccaaaatccctagctctaaaaaaaccggaaacggattgaaaaccttgaatctaaacaggctgctactgtccgggagaaacaagaattgctgaaaaagcaaaagactttaaatatcattcgtcaaaatttcactgctctgcttagtgaacaaagttcacagatttacccttctcaacgagataatgtacaactataaaatgttttgctttagtcgactgatatgtaagaagaacactgactgcaaaatcagtgtccttctttcttcttttacatatatttcataatagtcggcaataatacattcatatctattggttttgcaacatgatcattcatgccacttgccaaagccatcttcttatcttcttcaaacgcatttgctgtcattgcaacaattggaatctgcgatttgttaccgtctttcagttctcgaattctcctggatgcttcatatccgttcataatcggcatctgaatatccatcagaatcagactgtagtaattttgctttgctttgttaaacatatcaatacatgcaacgccgttttccgctctttctatcatgattccctcttccgtcaaaagttccgttgcaatttctgcgttcaagtcattatcttctaccagaagaaccctttttccttccagttttttgatattcaactgaccgtctgcatgtttcggattcctttcttccgcatttgctatttttaatggaagcgtgattgtaaaagtagaacctgctcccggtttgctctgaactgtgatcttgccattcattaaatccaccagtttcttcacgattcccatgccaagtccgctaccttctattccgctgtctgacgaagatcgttcctgtgaaaatgattcaaaaatatgtttttggaattcttctgacattccgattccgttgtctgctatgataagctctaatacactccaaccttctttttcgccgggatattggttcaatgtacagcctatgttaccgccttcacccgtgtatttcacagcattactcaaaatgttaatcgtaatttcagatgatcttgcatcatccatatacaagtatggatatcgaatgttcttattgactttcagtgtttgatgtttttcttctatctgtttcctaaacatatcaatacataaatcaaagtttttagaaacatctgttattgtttcatccagcgttgctttgttgttttcgattcgtgctaattcaagaatgttatcaatcaaatgcagcattttctttccgcacaataatattttttcaaagtaatcttctaatatagttggctcctttaaatgtttctctcccaattctgcatatccaatgattgcattcataggggtacgaatatcatgagacatattaaatagaaatgttgattttgctttattagctgaatcggccagtcttgcagcttcctgcaacagtttttgctgtttctgctcattttctttttgcttcttatatgcagaatatccacaggtacataatattaacaaaatacacgctgtaatgcatcccagtacaatacttagcttattcgtcttctcaaccattccatacgctttctgcatatccatttctatgcagaaagcacctatcacttcattagattcatcttccgctgtcacaggataacaggctgtaaaaataggtccccatgttgtatcaacaatatcctgagaatatactatttttccagaaagtgctttttctatataaggaaccatctccttttcaatcggatctcctggatgtctgacgtcaccagccgatggatccagtccgtctacaacgtaaatcaatctaccgtcttcatttctggttgctgtgtaaatatatctcgtagaattcagcgttctgatttcattcatatatgtcgacatattcttgaatagttctgtattctcatcagctttactttttatttcattaaaatcttttcgtcccagtctgtcatttaccagcttatgaaccgcatctgcactggaaatatctcgttcaatttctgttttcagagcagttttggtatatgcttgttgtaaaataaaagtatatgcaacaacagccaaaatcaccattgccagaaggaataccaaccgtccctcaaaaattttccaatgatttaccggattttgatcttttcttttttgttttatatagttatttttcatcatcgtatttcacatgccttttccctaattttaatttaatacaaaaatgcctcaactcttcacgtattttgcaatatagtggttcagttgtcaagacaaaaatctaagcattttataatgaactgatatatgtaactgggtaggggagaaaatcccccctttctgtagtgtttacagtatgtcagattcattaagaaatgtctcttgaagtgtcttaaattacgataccattatagaatgcactgccgtaaagtgattgaagatttcaaatctgctaaaaatccaaacgcataccggaccaaacatcaagcagaataccaactccacgattcactaaaaaaagagcttcaggatctcggtgttaccaaaatcccaagctctaataaaatccagaagcggatagaaaatcttaaatctgaacaggctgctactgtccgtgaaaagcaggaattgcagaaaaagcagaagacactggatatcatcagacagaatttcacagcactgcttaatgctcctcaaatatcaaacaacgatatctctcgtaccgttgcatcctctcttcaacattagtgtttgcaacgttttaagacgtataatacaagaaaactgattccaccgcaatggatcagttttctttaaataatagctacttcatttttctcttttatagagtcctacaatcaaaccaagactaacaatcgctattaaaaaccatgcaactatatttgttgtatctccggtttttaccgtatttattattttctgaatagtatttggcttatccggttttgaaggtgtcgtatcctttggcttatctggattgctcggtggtgtttctgatgaaacccattcagcttttggctctatcgttacattatattctacattcccattaatttcagatgaaatattaacaaggaatggagcggattcaaatttatctgtaccactttctacatttccaatctgtgcaagcaggtaaattccttcatccaattctccaaaactcgtgcatcccgaagtatctgtttcttgcattaatccggaaatattattttctttcgcaaatgcaaacaattgttttgcttgtttctctcttgcttctgcactggtatcttgtaatgatatccctgaatctttaaaaccatcttcccatactaactcattatttttcatatattgaattggaaatatcgagaactttgctccggaaagagtcacttctttatccgaactatttctccctttataaataatttgaatgcttcctgttctacttcctgcttcagcatggattgttgaaatatctataaaattaccgacaagaaaaagcataacgaataaaataatgtgaatacttcttatcttctttctcaccttactttcctcctttttctatctcgtatactataaattatagctatcatcagccctatgaagattactacaattgttacaatcagcactttagcagtgaaagataactctggttttatattggtatcaggctcttgctttgttgcctcttcataaggtattctctctccacgaactaaaagtctatgtgtgttgattgcaaatggtgtacaagtaacaagtgttgcataatccttacctggttcaatggataagctatctgtctcttgtggcaaaaccgttaatatctgatcaatctgatatgccagggtttcatctaagactttaatgtaaaaaatatcccctacttccagtttatccatattggtaaatagtgtttttgtcggaagacctctatgtcctgtcagaactgtatgtgtactttctccacctacaggaagagatgtaccccagaaatgtccgacacctgcctgtagcacagcttcacttgttccgtgatagattggaagttctatattaatcttaggaatacgaatgtatcccatcattccagaaccatctacgttcaacagttcctcatagcgagcatctatttccacatcttcttgcgaaaatggatcaatcaaatcaatatttcccagcatttccttattgtatgctctcgcatcttccaacatctgctctttttctgccttacttaactttatactttcctcatcataataagatacaactttggaaccattcttttcgttcagataactactaaacgttggatataacaatacggagaatgcaaccaaaagcacgatcaaacgaataatatcttttattgttatcttcttttttttcttcttactcttcatttcattctccctgttgttatacttggaattgcggttaccttccgtggaagataaccgcccattccttaaatattatcttgtatctctggtaaaattattatgcttcttttctcttatcacggataaagcttactgctacaccgaatacaagaagagctgcgattacagcaaatgcaattgctccacgtccaccagtggatggaaggagggaacctgtgctgttttcgatatcgatgattttgtctttctcatctactccatctttggaaatagtccaattatttacatctgcatctgcactttttttgattgttactttaatcggagctgtcagcttgttgtatcctgctggagcctctgtctctacaagccagtaatctcctgctttaagaccatttacatgaaggttataattttccccttcaatacttgctactgattcaaatactgtattcttagatgttggatctactacatattttccatcgcttcctgaaaccgtaatagcgtttgttccagcttttgcatctgcctctgttgtataaaggctaaattttgcacctgccagctctttttcactagtcttttccttctttaaaatatccagtgggtaagtcggtgtctttgcttcacttggtgttgtttttgttgtttcctttggattattaccgtactctaactgagcattattcttttctgttacaactgcgtctttatttacttttgcataatatgtaacagtaaatgcttttcctttgtttgtctgattagctcttacccattcagataaatcaagagacatttttttcttgtttgttgaatcaagtgttgctgttgtaggtgctttgcttgcatctgcaatttcttctccaaatgctactgctacagtaactgttgtagcaccttcttcaagagctgttccatttgcatcatttacaaaatcaagacctttagataattcatcgtgaataatgtactgatactggtcatatcctgttgtatccgggattgcacctgttactgtatattttactacctgaccgatttctgctgtttctttgtctgctgtttttgtaatacttggtgcttctgtttttaagtttactgtagttgttgtctcatcaactgtaactaaagaagactgaatctcttttccacctgttacatatacaagatagtaaccagctgctaaattttcaaatgtataagatgttttattttcttctgtgatttttccagaatttgctgtagctgataatttctttgtcagtgcctctgcagtaaaatcatttgcaaacttctgtactgcaccttctgtatctttaagagctaaaacagctgctgcatactcctcatctgttgttcctgtaaatgatgttccaagggctgatttaatcgcatctttataaccagtttcagtattcactgtatatgcatagttctttgattctgttgtaccagactctgtcacatcaaataatttgtacagattaattgtctgacctttcagatcctgtgctggtgttgttgttttcacattaactgtaagtgtgagtgttcctgttgcaccttctgcggcaaatgctgtgacagacatagccatcatcataatcgctgccagcattaatgccatgatttttttcattctcttcataacaattgtctccttttcttgagaatttttcttttatagtttttctgcttttttattttccttgcattttttatatctcattacgaaatataccaggaaaagcagaacagctatcaggtaaatcaaataacttccgtatcctccggtatccggaagacctgggaaatgtctattagttattgtgaaggtaaatccatcttgcgatttatctatcgttgttgtataaccatccacttttgcttctgtgatggaatacgtgtaataataaatttcatctccatctgtcttgtatgccgggagttcctttatcacctcctgccatttagatttatcgatggaaccttctattttgtaactctcgtaacgtggaactgtttctgtcttttcatttcctgtcttatctttccaggtacgtgatattgttaccgtaatactgtttggtcttgaatgatcaaaattgtttaaatccttccaaactttattgatcgtcagcttgatgttctcatcacatggatcctgtgactcggatggttccggtgtatcactatctcccgtgttcaatgttgttttggtatctgacatcaatactgcttttgctggtgattcataagcattaagctctgctttcactgagtcacccttacttgccagaacagcattttttagagtctcaaaagtctttaccggattcatatgtcctattgtataaatatcccatccgcttgcatcatccttttcatgactgctgttcaagatactgttattctttttaatttcatctaaagattgatctaattttctgtaaatacggtaattattgttctcgccttccaccttatctaatgtattgaattgatattgcgaatccaattcactctttccgctaaacggtccgacaagattttttgttccacgaaccacatcacagtaatacatgttgttattcttcaaaagtccttcatcgttgaatccaacaaaaccaccacttcgtccatctttagcatcaccgtcattgtcatttccggctccaccggcatagacatcatacccatgactgacaccgtagacattactatcagtaattcttgttcgattggccttgatcagactcacactgatattggatttggcatcattatcattcaacaatccattttcgtcgcatcgaagtttgatggatgaatctccaatcgtaataattgcaagatctgtctcctggttgttatctgttgacttcttcgaaagtcccacagagatatccagtccgagcagatttacatgaagcagtttgccctcatacagtgcatccactttgataattccaagattgatcttcagaagattggaatcctggattttatccagatataatgcttttataagttcattaacaagcgagaatattacattcactgctccagaatccaacttcaaatctgcaagataagcgaaacttgttcgtcctgcaaatccgccggctgttccacctgacgctacctgtttcagtccaattttctggttcgtcttgtcacctgctgtacaattcgacattcttgcaagatttgcatatccgataaatcctccggcaatctgctcatctccatttgtactctgcacagtgtaaccctcatcagttcctgtaactgcacagtcatcaatgtgagaaccaaaaatgtccataactccaagagcaccaccaagcaactgtcctgtattgtctccaataacgtctatcttgtctgccttaactactccgctctttccagaatagccgacaaatcctccgacactattcaaacctcttacattacttaattctgttactttactgtttttcacagaaccatttagcaatgagccgccaaaacctccggctgttccgctatatgtaacctggttgttctgtccggattttattgctgtgtttgcgctgacacttaaaccagcatccttacttccgtttacagttccgtaatatacataacttctaaatgaatccagcacatcggttcttccaagctttaataatttatcaaggagcgaggtctcatttcctgcactgatattggcaactccggctacgtcagcaacaccgaagcatcctccggcatattcacctgctactacagaacgaatattctttacatgaataccagcttcaggtgtacccttttcaccaagaactgtaccttccagcattcctgcaaaacctcctgcagtttttgcgtaagaagtattattcttacctgttgtatatgcaccatttacgatatatccccagtcatcccaggattcaacatctgcataacgtattgtcgcaactgtcgcattaagtactttaataaggtctgcaggagtatcgagtagtttattaagaagcttacttaataatccttcacctgcagtagggttgagtgtagctacactaccaggtctagagcttcctacaaagccgcctacgtagcttctaccatctactcgtctgagtttcttaacctgacaatgtgcagtattgtcaccccagatttgtccaccaagaagtttaccgacatatccaccggcataaccacagttatccttattatcaattcctgtagattcaaccattaatccactctgatatccttctacagaagattgcttgataacaggtacaaacacattcagtacattgatcattcgtcctaaatcaagtttaagacctaaaatattcacaccaccaagatctgcagcaccaccattgatcatttctcctgcaaaaccacctgcagttctcataccagtgacacgttttgtctgatatgcctgaccatttgtgatagtacctgtctgcattgatccaacataaccgccagctgctccgccatttgccagttttgtctcatctcgataattaactcttcctgctacaacattgtatccgtaagcatactttcctatgatcgcatccagttcagcctgattagttactgttccatgctcagcaagatcacttccgtaaccaccttttttaccgacaaatttcacccatttgttccaggtttcataatccatctgggcaagtggtccataaactgccgtattttcttccgtcggatagacaacactgagtgctccaaggatgttatctacttttaccagtccccataataaggacagatttccggtacttgctgtatcggctgactccataagacctgtgaaaccaccagcaatttctcttccgtataccgaacggattcttactgctttacaagtacttgttggtccggtatattcttctttacctttccatttctttgtattgtttccccagatgtgaccgccttcattatgtcctgcataacctccggccatacctcgttgtacctgtgttgtggaagccgcatctgcacgaactgcaccaccacaaggaatacaagtcgtagagctgtttctgatcgtcggtacaaagtcctccgctaatgatgccaatgtatctgacacattaacaagaccatctaagataccagtatcgccaaggacatttgccacatttcctggctgcaagtctcccacataaccaccggctgtaatctggccaatgatataagaaaagttatttgcatttgaatcctgaatgtgcccaccagaaatctttccggcaaaaccacctgcatcaccaagtatgtcatttgctgatgcatcggatgctgtatttttccaagttgcttttactgcaaaacctctaacatctcctgtaacattcgaatgttctattgtagaaacaacgacattcaatgcatccagcacatttttgattcctattgagtgaccaagtacgctcaatccttttccaacagaagctgcggaaccaatattcatataaccaatatatccaccggcatatcttgcacccgttactgcatatgtactatcctgtctaaaataatttgaactatcttcaccctctaaatttttaggaggtgttacctttgtatattttaaatttgttacatcacaatgactaacttgaactccactgccataaccaataaagccaccagcactaccagaattcgtatcatccgatttgattttattagccgtaaccgtaaatccattatcggatttaactcctgcatattctattgttggaacatatgcatttactaagtttaacaactctccaatgtttatattcagcccatctatatttcctagaatactaatacctttactagcatcggccaatgctccagaataaacatttccaccaaagccacctgcataggtttgaccatttacagaatctaaattgtatactgcgtaataatcattagttcctcgtgaactgttatcaactgtaccactttgaaaatctgctgcaaaaccaccggcaacatctgctgtaacacttccaccattcacaaaagaaaccgtgcaatttgtatatttaggaattaaatatcctacggcatttactaaaccatttgtctctattaatgatttaatcgaattatcatcagcaacttctgctagaccacctgtttttgaaataccaataaatcctgaagcatatccgccattatctgcagccttcactgattttagatttgttacatgagaattttctatttttgtacttccgctttttgcgataaaaccagaagcactataatcacgaaccgaattagaatcacgactaccctttgcgtgtaccgtaaacccatccttaattccatttacatttgtatccttaatttttacttcaattgcttgtcctaaagaaagtaaattattcaatttcaacaaataattcaaacctaacaggttaacagttaatccaccatctgttccagccaaatcaccaggaccagaaagacctataaatccgcctactaagttattgccttctatagaagctaaattattgatactaacagttgttatagaaccaccaatcgcatctccaaatccaccggcaacacgttcatttcccgtaacagcaaatccattctctgcaccatttacatgaacattatctacagtaaacgcaagataagatgcaacgccaagcgttgtatttaataaaccggcaacactggccgtacccattgatccagcaattccaccaacataatcatttcctgtaacacttgataatcccgttaaagagctatcaatcacttgaacagaaccaacatcataaacattatttttccaatatgatattttctgtaaattatccgcattcgattgtgctatatatgcaccattacctcggcctattacaccaccaacatagtcctttccactaacttgcagtggagcatttacagaacatcctaagatatgtgatggattcacaccagcaagagaaagtaaagatgaagttgctccaggattactactcaaaagttttacaacaagatcaactacaccgccaagtaaattatcttttgtgtcatctttacctaggtctgcagcccatccaagagatgcaattcctgcaaaaccaccagcataatttccagaagctgttacagtgagtgcattatccgatttaacattacaattgacagttgatgcattggccaatcctccggcaaaaccaccaatataactttcaccagaaacagacacaactgcattatttaatgaacaatttagaagtaaactttccgtattcatcttaggaagttttgtctctatatccaatgcccctgatagtgttccttcaatcacatcatcacgagctagaccaacaaagccacctacaaaattctttccactaattgtattcgtaccacctgttacagaacaactctctacaatagcacccttttgcataccaataaatccaccggcatattctttatcggatgctgtagaaatagttaaactatttatattacaatttactatcttcggattgatatatcctgttggaattaactttcctaaaggaattgcgttccctaatagaatcttaattaaatcacctaagcctaaacctggaatgacatttaaaatatttgttaataatttaaccaaatcccctaaagcattcgataatccatcatattgagttgaaccaacggcatatccaacaaaaccacctgtatagccattcacattttttacatttgcattattgacttcaatatttgaaatttcaacctgcccttcaactcgcccagcaattactccagttgataaagctgtaggatcttttttacgtgcatctaaaacatcgcctaatgttttgcctaaatcaattttcacttgcccaaaagttaaaataaatgttaacccactcaacaatccacccaataactttcctagagtctgtgtaagtgcacttactaatgtgtctggataataggtttcatttgttgttgtatgaacttttagattatcaaattgaatattagatacctttaccaatcctttactaagaccaatatccttttcacttacttcacttgatattgttgaaaagaatccaacacccatttgttctccaacattaatcttagttgattgatctacagttacattcgataacactggtttatcagttgtatttaaaacattatctttccaaagtccacctttttctgcagatttagctccaatcattgttccttgaaaagtaagaggcttccactctttactgctcaaatctatatctcggaaaataatataatttgcgtttgctgtatatttctgtcctgttgttttgtctatatctaaatcagggtcaatttcacctgttatctgattgactccacacctgcctctggtatgtacccagctatgctgactgtatttgctatcagcatctttaatttgtccaaaagtaaaatctgctactccattctggtctcttgtcaaatcagcatcaccactataaagcatgatcggtttgccacttgaatctgtatcacgtttccataccaaaccatctagatatgcctgataaaccgcaccattaactcgttcatccgtaccaattttcctcagctgctgctcatttccaattaagatataggtcttatctccaatagtcttaacaacttgtcccttaaaatctcgaccttctgtaccttctgtactcactttactcaactgatctgcaaccagttctggtttatccgaattaaacttttgcgataacacataattatgagacttactataagtcagatacgccttatcttcaccatctggatagatcatctgccccataccaaactgtggtgcatcataatctaatgtcataacaggttctgtttcagattcttcctgtgcaagcaccatcaactgatacggattgtaaatgtagatggtatccgtttctttgtcatataaagtcggtgtttcattttcctcaacttctgttcctgtaatagttccggtaaaggaatctgacactgtccagatctgttcagaattcatctggatatcattcatcaaaatgtattgggcatctgcaccgtatttcagctctgtgccttcactatttactacatctccagaaccaatcttttcgtccttatcacccgtgtaaacataatcatctgaaccaatctgttttaattgttcataattataaatgcatattttactatccttataataagcatctatgttatctgttgattccgatttaacatttccaccggacgattccgattcgtcatttttcgagttttcacttgtttcctccgatatcttagattcggattccgtggtgccatttatttcatctgaaactgtggactcggttgatacttcaccattactcttattggcatcatcagaaagtgtcacttgactcgtgttggtacccgatggatttacgtctgccgcatccgcaatattcacttgagaaaataagatagccatacatagtattactgcgataattctgttctctatccttctttttttcttcatatctggacctctaatcttttgccttcacttgttactttaattttgcctttttaaccagttttgctgctttgctgcctcctgaaagcattgcatcagctgatttgaaaacgctccacattcaccatttgaaatcatctgtattgcctcttccggttcatatttccttttgtatgggcgatcattaatcaatgcatcgtaagcatccacaatcccaacgacctgtgcacacattggaattgcattccctttcaaaccgtccggatatcctgatccatcatatctttcatggtgatgtctgcatatttcatagctatattgattcagcttttccgttgttatcccttctgggaatctctgggtcatcgctgcacctactaatggatgttgctttactacattcatttcttcatccgtcaattttccatttttatttaaaatttcaattggtacttttatctttccaatatcatgaatcggtgccaaatgagctactgacgcaatttcttcatccgtaatcccgtattccggatattttttctgcaattgaagatatacctgtttcgtatagaaactgatgtcatcttggtaccctgcttcaactaaatgattatgattcaatacagtagttaaaagtgataccatatcccaatactgctttgtcatatcttgttctttttttatgagttctcgttccatctttataactgtgttctggacaattttctcattatgtaaggtaataattgcagtattctcatttgcatctatatatttttttgcttccatccaaacatatgcattcttatcttttccagtaattctgcgatatggaagatctttttccatacatccatcaactagtctttcttctaatccttcacttgataagaagtcatgaaccatttttttgtcagaagcatacacgtatctttctacatattggcttatgaactcttcatagctttctgttttccttactttctcatacacttcacggatatgtgaatatacacactcgtagcttttttccttcaagttcagttttaatacaacataaaatcgtccaaaatatgtatcttctaaatttctggaacaaaaacgatcttcttccaaacaacgattaattgccattgtttcctctacacacgatataatatccattaaagaaatgttctccagttgttttgccagcatgtagccaccatttgtaccttcacaggcagtgactatttttgcatctttcagtttttttgctattgccggaacataattagtagaaacatttagcttccgtgacaattctgatgtagataccatccgttcctgtgctgctaagtaacacacaattctaattgcgtaatctgtcgaattttttagttgcatcgttatccctctaacctaaactctgcgtggtcttagtttatattcaaaaaaatactatcctctgtagtagtgattcttttcctgaaatattttctcatcagtttcccaattatacagattaaaaccggttaatataatgtacaatcaatgaaaatatttatccgtttttttgtaaaatctgttccattgtatcgatattctccattaatatctttttatgaacttcgttcaaaaaaaagaaaccatgcctcaacacgatttttctttctttttctattctatttcttttaacattctataaataattagaccattactgactgccagcacttcatttgcattgtcaaaattaattccagaaatttgttttattttttcaagtctgtaagatatcgttctataatgaacaaacattgcacctgcagttttcttgatgctttggttatttctaagatacatctgcaaggttggaatcaattctcccttatgttcatcatcatataaatataatttctttaatgtttccggaatgcatctttccaattccgtcatatcatcaactttgtcgaatatctggaaaaatccgaggtttgaataatgtactactgacttactcttatcaccagtcacctggcggataatctcaatatacttgatagcctgacttgcttcgtgataagattctttcaatcgttgatacccttccacactttttcctataccaatctgaaagtctgtatctttctttctataaaggatgctttgctggataacctcctctatttcttccatctctttctgatattccagttctgtctgattggaatctacctgttgaatcataacaatctgatccatatttctgtaaataagcgcatccggcaaaagatgcatcaattcaccctcgataacccctacttcgtgaagctgttcttttgtatattttctttgtacattttttgtgatggtatgaaaatcaacaaccctgtaagtatcgctttctttcattccgagctgtgctgccgcttcagtcatttctttcgaactcagtaatccattcagaatattttggataatatctctctgatacgtctttttttcttcatcctgtgcaaattcactcaaaaatccatcctgtaagttaatagtcgcattttcgagttccatacaaacatcctgttctttttttcttagctcctgttctattgttacaatcgtattcggaatcacttttgtattatgaaatgtaataattgctgtattttcctttacatccacatacttactagctttcatccatacatacgatgtaccgttattttcgatgattccgcgatagaaaatttcttcttccacacatccatctacaagatgttctgttaaattctcacctgcaagacatttctggacatttagccagtctgcttcacaaatatatttttccgtatatttttttataaagtcatcatatgattctgctgtttttacttgttcatagacatcatgattatgagaataaatacattcataatctttttctctcagattaacttttataatcacataaaattttccaagatattcatccttaccaggacggataatgtctgatatctttacgctttccaagcggttattgtatatattttgcagatccagcagaatctgatgtactttacagcaggctatataatttttggagcaacctccctctttttccaggcacctgctaattgccatggtgggttctgtacacgatatcacatcccttaaagatatattctctggctgttttgcaatctgatatccaccctttatcccttcacaggcttttatgattcctgcttgttttaatttttttgttatttttggaatataactgtatggaacacttagttcctgagataattctgatgtagagatcatctggctttgcgctgccagataacatacgattctgatagcataatccgttgtacttgtaagctgcatagtttttacccctttccttatctaaactaaactatttcaagtattagttcgtcctaaaaaattggtgggttcctgtcggacgatgaaattgattattcaaaaatttccatcaatttcatcaagatatgggggtcgttctactctatcatcagatataagatctagaattctataaataataatatcgcaacatatagtaatgcgatgatggcttttcaatataattttttctcattgtctatttgaatcagagaatgtttctcatcaacatttctaaaattatataccattttcattttttttataatgttccaaacaggaaaagattttttatttttttgtaaaatctgttccatcgtaccgatactcttccctataatacttttttatgaacttcgttcaaaaaaagaaaccatgcctcaacacgatttctctttctttttctactctatttcttttaacattttataaataatcagaccattactgactgccagtacttcatttgcattgtcaaaatttattccagaaatttgttttattttttcaagcctgtaagatatcgttctataatgaacaaacattgcgtctgcagttttcctgatactttgcttatttctaagatacatctgcaaggttgtaatcaattctcccttatgttcatcatcatataaatataatttctttaatgtttccggaatgtatctttccagttccgtcacatcatcaatttcgccgaatatctggaaaaatccgaggttcgaataatgtactactgacttattcttatcaccagtcaccaggcggataatgtctatatacttgatagcccgacttgcttcgtgataagattctttcagccgttgatacccttccacactttttcctataccaatctgaaagtctgtatctttctttctataaaggatgcttcgctggataacatcctctacttcttccatctctttctgatactccagttctgtctgattggaatctacctgttgaatcataacaatctgatccatatttctgtaaataagcgcatccggcaaaagatacatcaattcacccacgataacacctacttcgtgaagctgttcttttgtatattttctttgtacattttttttgatggtatgaaaatcaacaaccctgtaagtatctctttctttcatgccgagctgtgctgccgcttcagtcatttctttcgaactcagtaatccattcagaatattatggataatatctctctgatacttctttttcacttcatcctgtgcaaattcactcaaaaatccatactgcaagttaataatcgcattctcgattgccatataatcaagttctatcagttctctattttcttctgtgattgttatatatatatccacctcactcaatatggcaaatttcactatatattgaacacagcttcctttcatctgcttcatatattgaaatttcgtaataatattgggtttatatggctgaatttcatctgacaatattaacttggagttgtccaagtttgttgaaaccatacaattaagattaccataatacaatacaacaggattctcgatcatgatgcttaaaaatttgataatatcacttgctgtattgcttgatccattattttttaaaataaacgtattaaaattatcatgtgtaattttaaaatactttaagcgtgcagtgtctttatcgaatacctgcatcataacatgacggataattccccagtaatataaatctcctggaatttctaccagaggaatttcatattttttgcagtgcttttctaataaactcaatctgcgtcctgtaggatcatattcttttcttttctttacaatgaatccacttatatcacttttaactaaatcttcaaaatgctgctctacttctcgatcactgcatgataaatatacctgaagactggttatgagtatttcaccacccgtcaggtatcgctccatatcttcaatttcgattattcgaatgcctttcacttccaaatctagacctttttcaccgcaaagcagcttcatttttggaaattgttctgattcaagtaattttcttacagtatatcccatcgttactccttatccattgccaaatcaatacaacataatatctgttatgttgtttatggacagattatttttcgtacgatataatgttaaataacaccctgctatctgttatgctgttcatattacatagttcctttctgattttttggtagctgtgccctatttaagtaccgcttttggtaaattggctataatctttattatttttattgcttaaagttatcttttagaggaaatgaatgacttgcagaaatagggtagaacaggttaatagaggcactgtacaacataacagatattatgttgtacattccaatatttcctgttcgacaatcttatccagcttcttttggaacactgtttctgtagttgctgtatatattctcgttacattgatactgctatgtccaagtaaatccgcaagacctgtaatatcttttgtcactttataataaatccttgcaaatagatgtcgaaaattatgcgggaatatttttgattctgctactcctgccttttcttttaatcgtttcatttctctccaaatattacttctgtcttttaacttcccatttttcgtgacaaatatccaaccttctgctacttggttattatggcaataggaaagaagtttcctttgcaataccttaggcaaaaaaatccttctatactttcctttattataaatctctatctttccagattttacacgctccactgtaaaatattttatttcactgatccggattcctgtacatgctattgtttcaatacacaatgcaagctgttcttttccttctgccatagctgttgcaatcaatttcctgcattctttttctgtcaattctttctgatcctgtaaaaaaggctgcttctgcacttttattcttttcactttcagctttcctacattcaaaaattccaggaactgattcaaggcggcaagcattgaattaacactattgacagcatatttttgagcaagccattctttatattgcaacaatacttttttattgatccgcttatcatctgccaaaaaagataaaaacttttttatatctgccatatatttattgattgttgcctttgcattttctttctggtatagataatctgcaaatttttctatctcactttctgatacctctattgaaaaatccatctgttccataatcatagtcctcctgagaattcattttctttcattatagctgttcgctttttcgtattcccatacactactttttctacttgttatgtatccacggtttttcaatatttatctccaattatatatcgtattgttgattttagtcaacagtaggcgattatttttatcatcgattgtggatataatttaacaatacgagaggagatgttttatactaatgtcggatagcgaattatgtttacaggaaattggaaaaagaattatggatcgtcgaaaaaagctgggactcactcaagaagcacttgcagaaaaaggtgaagtcactacccagtttgtttcttatgctgaatcagggaagcgagcaatgaggcctgaaaatctgctaaaaatctcctctgctttagaagtaagtgccgattatttactcactggtgaaattatagataaggatctgttgattctttcagataagctccgccgactcactccttcacaggtacgcacagttgaagctattatagatgaatgtaacaacctttttaatcagaaagaaattacccttctctctcaaaaaaggaatggaagctactaaaacagttaatgacattgcgtatttataaagttttttgccgtgcagaaataaaaaaccttgaggtacaagctgatttttgctcatatctcaaggtttaatttctttttgttggtcgctaatcatttttacccttttcaggataattatatttgcaccttaacattcaagttgctcaaactcctttgcgtactgcgtttcatgacacgcaaaggcttgatgttgtatcataaggaggatgacagctccatctaaatttatcgaacaagctataccatttcaactcacatcctcacaaggaggatgaccggaaattatacagaaacgtatcgaacagaccatatttcaactcacatcctcacaaggaggatgacggcgagaactcttggaatcgttatattcttttttatatttcaactcacatcctcacaaggaggatgacctcgttctgctgctttctcatcccagctgtatgactatttcaactcacatcctcacaaggaggatgactctatttctgtgccggcactggacaagatatatatttcaactcacatcctcacaaggaggatgactactgattctcatagttgttcttatcgcaagatatttcaactcacatcctcacaaggaggatgacgataaatactattagtatgaaaatattattagatatttcaactcacatcctcacaaggaggatgactatagtctatcataaccgtacatgtagctttgacatttcaactcacatcctcacaaggaggatgacaaatcagagaaacgattgcaacgctgaaagatgcatttcaactcacatcctcacaaggaggatgacggtagatggctctataccatctttctaggcagtttatttcaactcacatcctcacaaggaggatgacttgttttcttttttttgtcttcttcgtcagcatcgtttatttcaactcacatcctcacaaggaggatgacagtttccgctgctattgttgcatctgtatcatgtccatatttcaactcacatcctcacaaggaggatgactgacttacaaggaccaaaaggtgagaaaggagatatttcaactcacatcctcacaaggaggatgaccttttatacatgggagtggatgaggaatgactgtatttcaactcacatcctcacaaggaggatgacagcatctaatttcgtattaggaattaatagtggaatttcaactcacatcctcacaaggaggatgaccatacgaaaacagtgagcgaaaactgtggcattatatttcaactcacatcctcacaaggaggatgacgatattcatcccatgtacttccattgaaaattttatttcaactcacatcctcacaaggaggatgacccggcaagattcctaattccttgatgaaggtagtatttcaactcacatcctcacaaggaggatgacggatcacatagcttccgctttccatcttgatataatttcaactcacatcctcacaaggaggatgacctactggatttcctggcattttaagtacaaaggtacatttcaactcacatcctcacaaggaggatgacgtaacatattcatgtccgctgaacaagggagatatttcaactcacatcctcacaaggaggatgacgtatatccaaatacacacccttgaatattttcacatttcaactcacatcctcacaaggaggatgaccgttaggtaatttcatataatcacaccttccttatttcaactcacatcctcacaaggaggatgacggcggaaatctgtacatacttagaatctttgttatttcaactcacatcctcacaaggaggatgactactgcacaattttagcttcttccggaacgataacatttcaactcacatcctcacaaggaggatgaccgtttctttttcttctttttcttctttttcttctatttcaactcacatcctcacaaggaggatgactatggtggtggcaagacttaccagttcactcttacatttcaactcacatcctcacaaggaggatgacttcaggtacttgatagcctccgagaacgagaatatttcaactcacatcctcacaaggaggatgacatcaatgttgttcgctctcggaacctttacatacatttcaactcacatcctcacaaggaggatgacgctattagcggcagcaatacatttgcatgacttacatttcaactcacatcctcacaaggaggatgaccttgacgaaagatacgcaattggacatggcattagaatttcaactcacatcctcacaaggaggatgacgaatacttcagttgcacaagacactcaacaggtcgtatttcaactcacatcctcacaaggaggatgactcttcagtggggtaaagatattgttaacggtattgcatttcaactcacatcctcacaaggaggatgacagcaattttaaacaaaaatactctatttaaaatcacattttatatcaacaatagacattttatatctattgttgacatcttttttcattttcatatatatttctaagcctaatttttctccttttctggtgcgaatgtcctagaaaatttatgtgcacttatcattcgcactagaatatcaacatatcctgaacatcaaaaccagacttagcaccaatatgttctactttatttttatatttttcacccagataataaaatctaaggctatctacctctttatctataatgttctccaatatattttttacttgtctacatttggttgcatccatttgacattcaaatacagaattctgtactctctgtccgtaattagtgcattcttttgcaacctttctcaaccgtctcctccctgctgctgtttgagtatttacatcatatgtaattaaaactaacatctgctctcctacttccagaaaaatggtggatactcatctaaatctcctctcaaacatctggctaatagcatactttgaacataaggagccattccccactctattttttcatctataaaaggatgttttatagtttcctgttttttagattgccacgctgataagaaaacttttctcccttcatctgtcataataactgcatcattttcttttcttataaaatatttttctttcataatttttttattaatcagtgtcaatacaaatctatccaccataatacctctaaattcttccataagatctaatgctaatgacattcgaccgggacggtctgtatgaaaaaaacctacatatgggtccaatcctactgcttccagtgctcctccgcacatcccagctaatagggaatatccaaatgacaacattgcatttacattatccaatggcggtcttttatttctcccatggaaataaaaattgtctttttgctgcaaaatcaaatcgtcaaataccgaaaaatatactgaagctgcttctccttctagtccaagtagttcctctgcattttcacattctcttatttttcccatgctctgagctaaaaacactgactttttctttatcgtttccacatctaaacgcagcgcataatctcttgcagctctctccagaatccaccttgaattatatacttttccaagaataaaatttcttgctatatgtacactttcatcccgattatcactgattctatattgttgttttcttaatgtaacattcccttttacttcacctgtaactcgggctagaaatcttccatttccagacataaaagacaaatcaatattcctctgtgcacatactcccataagtgccggactcgctcctgtatagccaaatgtaattatcgcttgtaaattatgtaatggaattcttccgatttctttttgatcttccaatacaacaacattttctccatctaaggacaaatatttatttccagatgtcacatacaacgtatttaaaagtcttttcatcctttttcctcttctgaaataattttatcaatatatccggaaactgactttttcttatttagaacaggtagacaaatgtcttttaatgagcatgcattacattttttacttattttcacttttggagtataacattgcgcgtaatacttgtgcatttccgcaaatatttttctgactttatcgcgtatttcatccgtaaattctacttttgcacgatgctttgtctctccataataaatatagccatatggtattgtgcaacacaacatttcttctaaacataatgcctgtgccgttacttgaaggatatcggaatcatccgtttttggttttcctcttttatattctatcggaaccactttataaaatccttcttttccggacaaactgattccatcctttgctttatgaaattctaccacatcacattcaccgctcactcccatttcccgggagtgaatcggcattgctctcacaactatcaaatcgcctcttttttctttaatacttgcatcgtgagcattttcatgaagaatcttaccttccactgttctgacattttcttgccactgtagttctatatacgctagtgcccattgtctcctgcaaaattcaaaatgctgaattcctgataattgaagaaagtcttcttccttatacaaattaaaattcctccggttgtttgcatccttctacatcccatgaaatctcataatcctcgaattctctcggatgttctttttttgcttcaatagtgaatcctctttgaattttaccactggaaactgccggtgttttttcatcatgctgccaccagtacattttgcaaacttccatacttccttccggtcttgcagaagacgcatcattctcaaataatgtctttaatgcttcttttaatacttccgcatcttcctgactaaaacctgttttttcagcaagttgtacatttacacttcccattaccttatatacagcaaatccaactctgtgttttgttcccatcgtatcagatgctttactttcttttccagattcactattcacactttttgtaatctgcatactgataatatcgattggtgataaacttactgcctgatgaatagaaacaggtccccgtaccccgaaagacaccggaattcctttaaatgcaaagacttgtccaaaagctcttacatctaaccattctttgcatgcaattgctgcacaagcatcacgatttgcatttttcttatttcccatctctgcttttaattcctcacagctatctgctcggtcttttaaactggtataagcatcatctgttctatcatctgactgaacaaaaatcttttgtcctaaatcctgaaaacgatttctaatttttctcttaatacatacatctgaaatttctccaaaaccatccatattaattcgcggacggtttccgtttaatggatctccgtttgggttggcattgtttgcactgataaataatgtgaaatcaatttttccttttaattcgctcatggtctactcctcctctttttactcttctgaactttcttctttttcttcagacttctctttctttaatttcaaatcatatgcctgattatggaaaccaagtagatataaaccttctaatctactgttatcagtaaatgtgcttttatcaaacagctcatcaatttcatgcaatagattttcgtaaaatgtcctttttgcaatatctagcttgttcaaatatggtcgaatattttcctctataactttccacgtttcatatggtctttgagagaaagtgctcatatatctttttgcatttgtaactcttccattatctttctcgtcatatgtcaaatattcaattcgatctgcaactgccagcagtcttccatacagataatttctatctgtttcctttttatctaatgccacgttccattcctccttatatctatcctttttatccttttttacaaacgaacatgctaatgtcaaaactctttcccaatttcttcgttccttatatgctaatggattggatgcctttgatactgcaagcatcacataatcatacggaaccaccctagtgccattccatatacatggaagcaatctttgagctacttgtgcatagagttttttaccattggcatccactatagacaccgttcccttattctcaataccgtataaaatatctgcaatatctttaacaccaaccattcccgcaaattgtattctttctccatctttccattttgtatgaatccagttacaatcgttatgccatttttctatatttttcagatatctgacagaattcagctcttgattttcaatcaacgctaatcttcccggtgttgctgcatcaaaagcaagcaaaatcatattcgaagtattatctatcttttttccatagcctcttagtgccttatagaacttatcggcggtgattggatttccatcggatacaatctcccctgtagaccagtcatcttcccaatcatcctcagcatttccaacatattccctttcatactcagatacaattgcctctgtatctctctcccattttggcatacttaattgatttgactcccatgtcacaattgtcatagtatcgaaaaaagtgccttgttttcgaataatccacttcaaagcattgtgcgctttttgcgaggtctcatttcctactgcaaatgcctcttccttacttgtaaaacgtcctcgataggtgaaattttgactgtcatttgcagaaatcagctttgctccatcaccttcatttctgattttctttgaatgaagataagaaatagattccatatttccagtcagataacatagacctttttctttttcctgtgacctgacatattctatataacattcctgcaacgctctgtctttccaacattcatccggagtttcctgataaagtttttcatcaaaagatcgtataataaatcgtacaaaagcttttggctgtggaattccttgaatattttctttctcatctatttgattttcttcattaagttttataattttatgtgcaattaaatcttgaattaatgtcgattttttcaaatacttataaattgctctgaccttttcatgacaataatcggattctacccatttttcaagctgtgaaatatatagctcgctacatactccatcgtctttataatattttttatagtcaccggcaagatatctcaaattatcacataatggatgtggctcttttccttttcctgtacgacttccagatttttctgtaaccggtataatcgtcgttttgtctttctgttccacttgctctgcacgaataaaatcacctgcttgatcaatcgttaccgttatctgcgccgttacagttgtatgaaatagcggaagaagtacataagggatgtctcttcgatattcgatgataccaattttatctgtatttttctcatacaaatcaatcaattcatttatccagctcaatcttccacctcctcatctgtaaattcttctaatcccacaaaattattcacttcttttccaaatacttttctttccattggacggatatgtcttttctccgtacaatcctccggtctggtaaattctataattccaccctttttcattaccggcctccagaaacgcactgtcatctgatctttatcctcttccagaatcgcctcttccgcataagtaatcccatgatacataaatccataacccacttccccaggcatcgtatcataataactcttgtcttcgccaaatacacacggttccacaaatgcctgacattctcttgttcctaagaaaatatctctgcgaccacctcgttttaccatccttttcgcaatattatgatgcttgttttcatttctatcctgctccagctccggatgattgagattcatctcaaaatgtgcccgcacctgatatctcacatcttttaaataagtataatatgccagttcatttctaccattgtatgcaatcggtcggattcctttagtctcagtctgaattggattcattactcttaccgcgtcaatgatccaaataatcgtaggcttccagtaaatactttccgtaattccttttaatgcttcgtaagtcggaatatgatagcttgtcttttctcctcccactctcataaccggatctgaaaaaagcgcatatgttccatgcacttcaaactctattgtatttctgtatctttccaaaaatctcacctcctctataacatttgcaattccatattaggttcatccacaacacctacttccttgtcataatatccatcacacaataccaatatctctccattgccaatttcatatatagcatttccgagtttttcttttcttttttcagaaattccaactgtatatctctgcaatttttttaaaatctttttctgctcttctatctcgagataatcctgcgataatttatccaatagttctctcgcttcatcattgtatggaaccacaacactaactttataatcattagaaataacttcaaacgcctgtcctgcggtcaaaaaagcctgcggtaattttgtctttactttttctccattccttctgatatattgcaattgtcctactttattttctcccaataactctataatcgtggttgtttgtttatctatcaaaaatttcgtttcatttgttctaagttgggaatagtaatttaaataatatgcttttattgcctcttctgaatccaatgtatctctgaattttaaagaattatttttataatcttccaatactttttgtaatgctgcctgcgcatttctaatttcctgcaaatgacttaatttctctgctttttcggacatctgtacaatgaaaacagttcccattcttcctaattccttatgtctattgcatcgtcctgctgcctgaattatattatccaaacctgctttagacctcacaacacacccgaatgaaaaattcactcctgcttcaacaacctgtgtacttacacatataatctttttcgattgttcattcaaaatttgttttatagattttaatgtatctaatttatgttgtggacacatattattactcaaatgaaaaagttcatattcttgtgtacatatcgcttttaattgttgaaatgtattcattgcacaagccgtagtattcaaaataaccaatgtactttgatattgttctgttttttccttcacaaattcacttaaatcttctatctccataccgccaggatataattctgttgcatctttaatatctgtccttttaaaagcatttgcatacttttccggtcttcccgccatttctatacattcacaaatgttattctcttttattggtgccaatgttggctgcgttgctgaacacaacacaactgtcgtaccccaaaattgagtaagaaaattcacagctaaattgaaaagttccatacattttacaggaattgcctgcacctcatcaaatatgataatactgttacataatgtgtgcattctacggatacagcttttctgagctgaaaacaatgtattcaaaatctgtactgccgtggtcactataatcggtgaatcccaagtttcagtgagtttgcgataccgctcttcttttccatcttcgcaaaccacattacaatgatgctccaatacaatatccgccttgcctattgcttttcgaatctcctctgcattctgaatcaatatagaattgaatggtgctatataaataatatgttgttttttcgtctttttggcatgatataaagcaaaacgcaaactgctgagtgtttttcccgctcctgtcggtacagtaagtcggtaaagattttgttctttgtctgcagcttgtctacacaaatccgaaatttcttgacgaaaagtatttaacacatttccatttgatggattattttgaatttcctttgacatatattgctcaaaattttctatacattcattccaaatcttctgcgtctcttccaatgaaattctttttgataacggaacatcttgaaaaaaacaagccgtatccgtccagtccccatcaataagtaaagataaaactattctcagatacattcccataaagaaatatctgttcccacattttctttttgatatttctgactctttatgaaaagtattgatttttccttccatttccttatatgtttgaattgcttttttgcagtattctactaatatctctttatcataaatctgaaagaattctttctttatccagtcataatctatttgtttttcatcccgttgttgctgtaaactttgtccattatctagattgatgcaatctcccattccgtgatgaaaatatataaccgtactgataaattctgaaacacttttttctttgaacaactccttgattaatcttccgccagcagtagaatgatctaaaccatgtttatgagcatcatccccatattggagaatcttctcaaaatcttcttgattttctcttcccagctttcccacatcatgaaacacccctatcaagctaaccaatatcttcaattctgaaagagaacaagtctccgctgcatagttcgcaacattttccgaatgctctttcattgtctgatatctacctgattcatagtctacgtgcgccaaatctctttttatttcgattttattttccatttatctctcttgtgttatctgtgtatatttttctttattcagttttctattttatatatttttactatattttatcaaattaaagaatgccatacaaggcagaatctaagaaagcattcgctttataaaatatcaaaggattctactttgctcatttccctgtttcatcactacaactccattttccctagtgcaacgcctttgttggacaagcttttgtgcattcatagcaaagaatgcattcagttccattttttcgctttcgggattctttattaacttccacgttcataggacagactctcaagcatttgtcacaatgaatacatttactctcgtcacaatgaacacgtaaaaatgaaaaataactcataggcttgaggaatactataacaggacacagatatttgcagaatgcacgattatccttgagtacaaatgccagtccgatacccaaaatataataaagcacatttcctacgatgaacagccaaaacataatttgttccagctttgcaatttttatcagcatcaaaccggataccaacgctaatgacagtacaaacatcacatagcgaagaaaaccaagcttctcttttcgtggctgttgcggctgtttgtaaggtagaaaatccagcaccatggctgtccagcaggcatagccacaccaaccgcgcccaaaaaacaatggaccaaatattttcgccacagcataatggatagttgccgcttcaaaaacgcctaagaacagataataccagaatccctcaatctgcatattttcatgggaaatcacaccgagatacaacaacatatagcttcccaccgccaattgtatgaaatgtctggcatactgttttccggcggtaaatagtgctgttcccagtccaaggcagcctcctatgtagctaaaatttaatagataaaatagatttttcttaacaagccacaatgtaactgccactatctcaaatagcagaaatagcaaaattgatggcacatatttgcgaaacttgtttcttttaattgcttctttttgtgcgggtttgctctgaactcttttatctttattcatagaggcctccttatcatttagctttcattcttgattatacattccgccccatggtttcagcaagtgaggaaatagaaaactctggctttaatgaactatgagccaaagagtaaaggacttgccctaatcttttattatcagcttcaaactctattttcatacgatgactgtacttatagcctttaaatcttcgcttccagctcttatctctgtcctgatagctttcatattctgtatcgacattaaaatatactgttttaaggtcttttctctgaaagccaagtttttcaaacaaatccttgaggagctctgtatcttctgttgaccttcggagagtatcttcatattctttgcaaagttcttccttgctgacatataaccggatcatatccggctttactgctattttaccttttcccgtaactttaattgttctcattatctttgctcttccttttaaaaccgctatcatcttctttgtcatctgaatatacttaccaaatggattaatcacaattccattaatcttttccccttcttctcatctgaatcagcatttttatctctaccaagagtatgatcaaactcatcaagaacatccgtcatcaagccttcatcaatccggcttctacactctgcaatcaatacagccggaattccataaaatgcttctgcaatactgcctgtgatagcaccaagcgtgtcagtatctccacctagtgatactgcattccgtatggcatcctcaaaatctttggattccagaaatgcaataattgcctccggtactgttctctgacaagtctcatccatatgatatcccggtctgatctcatcaagtgttctatcaagattgtaatgaaactccctctcgatgtattctttaatttcttcttttgaaaatccattcctagccatgtatattgcactggctgttgcttctgcacccttaatgccttccggatgattatgtgtcacatttgctgtcgctcttgctacctctcttgttctttccagcgaatcataaagccatcccgccgctgacactctcatggcggatccattcccataacttccgtatggctctgggttgctttctctaagccaatacctgaatcttccaccataacctgcatatggatatctttttccccaatcctgcatgttagttactagcgcctcttctatttcctttactgtagcttccgttccgactgcaagaagagcttctccaactgctattgtcataacagaatcatctgtaaagtcacagcctttagtaaacaaatcgaattcctttgttttatttcctctgtcaaactcaaatggacttcctataatatctcctaaaattgctccgtacatatatgcctccaatctccggattgctccggcagctctttttctttgttacaatataagtatagttgagcggcatctttatatggtcgctgtctgggcgacactttttaggacaaaagcaaacgccgatactacaagtatcgacgtaacatatgccaatcaatatttacttgtaacctctttatactcccaatatttcattcgtatacttaaacaaagtcacattcaactgcataatatcatactgcttatcaatgatagccttctgtacaatcagatccaccttactgcttggactaaatgcccaatctgctctggcaagtaaatcttttgactgttccaggtcaagccgcagtgcgatacagagtgccatcacagttttcttctttggatgatagttctggtcacactgaatctttgaaaaatgtttcctgtcaagatttgcccgtttccacacatctttattatcaagatgtgcttcgtcaatcagttcaaataatttatcatgaaaggaagctcctatattggccagctggtcttccaatgaaatattttctaacggcatgagtaactctgtcatgcctgtatctgtcattttctcaagtagatagttgtcttcttctctttgaagcatttcttcattgaaatcttcttctgccaattcttttatacgagtacttcttctgctccttatcgggtactcttttctatggatttctctgacgtaattagcatctatataagaatcaatatccccaacaatctgaccggacagctgaaaagaccttttatcaaacactaccagtatgatttccatttcattttcagtaagaaactggctgaatactgacacagcaatctgtaatgccttgttcttcggaaatccatatactcctgtcgaaatcaggggaaatgctatactctcacactcaagtttcaatgctttctgtaacgattttcgataacaattctcaaggatttcaaattcatgatgctttccgtctgtccataccggtcctactgtatgaataatatattttgcctttaagttgtatgcaccggtaacagcaatatcacctcttgcaattttgccgatacctgctctttcggcaagaagctgttcttttcctgccgcctcatatatggctaaatctgtaccgcttgcacatatcggattcgggttggcagtatttacaatcacatctgctttaacttttgttatatcgttacggacaatcttaaatggcatcgtgacacctcctagtattacaactctgtataagatatctgatattcaaacaaccgcattctcttatcattatgccctcttaaaataagttcctttgtcagattgttcaaacaaataatcccatatacttttttacctttgaatttttcacttttctcaaaccattcgaggtactgaaccgtctgttcataagcatcatcatagccactgtccttcttcaattcgacaacatacaaatttccttgattatcctcacataataaatcaagtcttccaactggaataatatattgtctgccatactcacctttacgtttatactctttaaggttcataccaaatactgacatatcactttctattcttgcagtaagctcattttctaacaacttttcattagagaactgctgtcgttttatcccaatgtctattgtaactttttcagcactgtcagtatcatcaatatctgattcaactgctacatcacacttcttcaaccttgcattgtgattatccagctttttcactctgtcacgaataactttagcgacattaaatcgggttactaccgtatcgtatgcgttttttgttctccttttctgctaaaaataaaaaaacacagataagatacatcaagccttgtttgtgtcatttttcggggcgaaaataaggtaaatatccctttctaagcctttccgaaaatcgcataaggtatttgtactaacctgtggttatgtattgaattataggttttttgtatataagttggaagtgaaactcgtgttatcagagagttatcagtctcaaattcgtgataagcatcaaaatgagaaataatataatcaccacgagtaactggcaaaatagagagttcattatccgcaaaaatccttggtaaattaattgtatggtcaaacttcgccatcagtcgtggctctcgtacttcctttatctgctttgctgagatttgaaattgcccagttctctcaatatgtcctaatatatcgtacttctcaaatagtttttcccacgctatgtcattaagacttttttgacgatcacttataattacgcaccaccacttcgtcaacatctccacgctttgaagcgactgaattaacagcacgtttcgctttaacaatggttatgttgtaagctgcatattgctccaatataaattctgttgcagaatttgaaagcataaactttatgccacgagcatttaaatcatcacaacactctctcagtcttatttgatcttctcgtgaaaatccacctctcgagtatccggtaaaacttgcagtttcagaaacaggatcataagggggatcaagatacacaaaagcaccccttggaacatttttcaatacttcggcatagtccattgtcgtcatacgaatatcagcagaattaaaatatgcactaacagccctcaatacaggtgcattcacaatattaggatttcggtaattaccaaacggagaattaaactcacctgcattatttacacgatacaatccattaaaacaagttttattcaaatataatactcgagcagctttttgaacatcagtcaatgtcaaataataatccttattgcgatctcagtctctaactgcatagaactgttcagctgtattttcaaatttctctaactcttcaatcagttcatcaacattttctttgataaccgtatatacacgaattaattctggatttatatcgtttatatatgccgtattaggctgaagatgaaacaacaatgcaccgccaccaacaaatggctcacagtatgttgtaattttttttggtaacagtgggcgaaaagtatccaataattgtctcttcccacctacccattttagaacaggggctaccagtttattctttctcattttgccaacccctttctttgcttcgttttttacataaaaattcattttaaattataccacctttttgctaaaattcaattacctgctactgtcaaatagggttgtttcatgaagctttcaccctatgcaggcatgggtagatgttgaagatagcttagatgtatggtaaattaatggtgaatacttctagtggattaaggatgaatatgtggtagaataacccatatggtagacttgtttaagagactaccatatcggaatttacgcgaggtgcattgatgaaacaactattgaaaatagatttacaaaattatgaaaattgcgatagcgtatttagtagaccatctgtaagaggaattattctcaaagataatagcaaaattacacttgtttacagtgagaaggaaaaatattacaaatttccaggtggagggattcacaaggatgaaataagaaagaagctcttattcgggaggttagggaagaggttgggttaactgttattccggaatctatatgtgaatttggaagtgtaatgcgtaggcaaaaaagcaacgtttcgccaaatacaatttttgagcaggaaaatttttactatatgtgtaaaacaaaaaatcggattgtagaccaagacttagatgattatgaagcagaagcaggatttacgcttaggtttgttagcttggatgaggcaattcgtgttaattcagcatataaaagtgaagattattttaatgaaatcatgattatgagagaaacaaaagtgttacagatgattaaagacgcaattcactgaaatcaaataaaaagattgtagctgttcagagcagaccgaatcacttgctgatgaggtcgtaagaacatgattcgtaaaatttaaaaggacataggtaaaatgagcttaataaaaaatgatataccaattttagaatatgacacaaacagcaaggctgttattatgccaggacacagtacgaattttcattttccggagagagcagtaatgctgtttatggaaacagagattgacgattatgctatgacaaataaatgcgagattatcggacagtttattagtatcacaaaagtctttcctgtatataaaacggtacataatggtgttgagttggcaatttgtcaagctcctttaggtggggctgcttccacacaaattatggaacagctgattgcgggtggtgttaaaaaggttatagccacaggctgttgtggtgctttagttgcagataacgagggggatttttatatccctacctcagcactacggcaagaaggtacatcttatcattatctaccaccttcacgagaagtcatgcttaatcaatcagcaataaatgcgattgagaaaatcttaatcaatcacaaatacaactatcaaaaatgcaaaacatggacgacagacggattttatcgtgaaacaaaagaaatggtggaatatcgcaaagaggaaggtttttctgttgtagaaatggagtgtgcttctctggctgcttgcgcagagttccgaaatataattttcggtcagttattgtttacggcagattcacttgcaaatatagaatcacacgataccagaaattggggtaataatacttttgcgttagctatgaatttggcaatggacgctgtaacggaggtgcagtaatgcaaacagaaaaagaaatgtctgtattggaagcgacaaaatcgggcatgattttaggaattttttgaaattattttttgaagtgtaaaaagacataaaaaaagatgccaggattcctcctgacaccgtagtaactgtgccaacttcgtgcccagtgggcacaaggttggttcatctcatcatatactgttgtaatttgaactaccccaaccgactaacgtcggatggggattcctacgggctttcgcccgatacccactcgttcagctcatgggtgttccaacagagaacaaacccgttttcaggaatgtttttgtatgttggcgtaagtcagatattcccgtccatccagctccctgcccactcattcaactgactggtacaaagtgactggtaagaatatccgaatatttcttctatttctatatttttatatttcgctttttcttttttctatcttcttttatacatactcatatcgattattttgcgtccattttttcatttccgatgcaatgctttttaatgttcctttttttctttcttctaagacttcataaggcagttcccggtaaaaactatggggcgaaactccacgaaatgcttttgttaactgtttccatgctggaatgatactcacaatatcggttccattttttagtttttcttttgccttttctggtaataacacaagtaaccgctcatccggtaacagtttttcccgaattcccattccttttaatccaatcgtatacgatgctgcttcatgaatggaaagtccaaatggtcttaaatacaaaaacttccccatttggctggtataagccggattcattttatagattccaaaactttgtttataggcttgattttccaaacaggtcgtcatttttcggtaagcaaacaaagaagcatgtcgattctttttcttacatccatacttcattccgtgttttgcaagcgtggtatccaaatcttccataataagcggtttcttccgttcggcgcaataacgtcctacctttgccatcactcttccgatttcttctgaaatctgcccttttgttttcaattccggtgaaaaacgaatgactgtcccacccagacggtttcctttttcatctaattctgaaactgctacatggtcataattcaaatcaatcgaaacacagccttttttcaaagattcattgcaatatttattttccagtaaaagcgtcaccgatacaatcagatatcttcgaccagttttctctcgtttcaactgaaaattataacaaatcgcttttcgttcctgtttttttgcctgaagcatttcttcccaaagttcctgttgccttgcaagatggaactgtttaaataccgtttcttttccatccatacattttacaatcaaatttctttcttcttttctgaccagaaagttacagttttttgaagtatgacgtcccggaaggctcattgaagcatggcgggattcaaagaattcctgtttccactgttcacgatcgacttttggattgtctttcttttgatattgttttcttccaccaaatacaattctcttcggtggaaacttttttaaccattccagcctttgaatggctcttttcttagaagattccattaatgcaattcttgttttcaatcgacgaatggaacgttctatttttctttcgtattcttcggctggaaagtaggttccatttggaagaaaaatttggtttcgttccattgtaattcgacactttggataaggacgctcccagattccgcttttaaaataagttcgcagagaagatttgattccctgcttcttttccaattcttcctgtgttcgttttatcttttgattccgtgtctcaatatctttttcttttgttctctgatacaatcggttcaattccttttgagaagaaagaacagaagacgcataagtatagatggcacaattataatagtccgttgttccatagttccttttcagccaggagctgtaggttccttctaataacggacctctttttaaaaaggatttgtcatacaagcagttatagagcttgattttgatatgattaaatcgttccatcgtctgaatcaaagactctacgttctggatttcatcctcatccagataataccgcttatctgcatttatcgttctggttaactgcatgaaaacactccttttctcaaaacggtttgtcggttaaaaatataacaataattgaaacaaccctttatttatagtataattatagcacgaatcaagccgttttacaacatcggttattttaaagaaaggagaaatttatggacaacaaaacttataccagaaatgctcattccatctgctgtctgacctatcatgctgtttttgtcattaaatatcgaagaaaagtaatcactccagaaatccttgcttttatgcgtagtcacacagattacttaatttcacagcgttatcatggaaaacttttggaatttaatggtgaagaagaccacctccatatcctatttgaacttccgccatccgctgcaccttctgttattatctgtaatttaaagactcagctttcaaaggaagtccgaaaacgcttctgggaacaaattcacaatcaattatggaaagattctttttggagtgacagttacttcttatcgacaactggcggtgcaaatttggaagtattagaacaatatattcaacaacaaggaatcgaaaaacaaaaacggaaatacgttcatcacaagaaaaaatgagcattcatccccaaccgactcgtcggatggggttttctgctctatagtagataaacgccactcatctttattacttacaatgctttttattagtattttagttctttgataatgtacagtatcatctatcacaatacggataatacccacaggagtattggttcgttgcgactacgaaaatgatacaattaaacgatgcaccccctgtgaacacccctacacaaaaaaagaacgccagaatcttatccaacgttctcttcattttcactttctcaagtcacatgatgctatcacatacatgtataaataaattgtacctctgcatttaactgaaacaatctctgatcttatttgaaatatcagaatcaacaaagcctttctgtgccatatcatcaagtatcccacacgctttgtcatgtgacaaacccttcttataaggtctgtcttcagtaagtgcctgataaatatcaatgcaagccataatacgctctggtttatttaattcatcagcagtttttccaaaaggatatccttttccatttaacttttcatgatgaagagccgcccagtctcgtatttcctcgaaatcatctatccctgacaaaatataataggtatatactgcatgatgtttcatcgttttaaattcttcatcggttaatttttctggtttttccagaatctcattcccgattgcgacctttcctatgtcatgtaaagctccggcaatatacattttctgacagatatcctcatcaaatcccatgaaccttgatattttttccgcaacacccattgagtggttacttgtaaagggtgatttatagtccacaatatgggcaaaaagatctgcaatagctttaatctgtgcaaaattaagttccagctttattctgggtactttcttccacaacatcgtatccagggtttcattatcaatcatatgaattttttcatctgaaaaagcattaaaaaaaacttccacgcagaaggaatcaaacaatttatcttttgactttattacaaattcttctgttcttttccactcatccgaatctgatttcatagatcggcaaaatatatctatcgtatcacacatatggataatccttgcaaaaaacggtacttcattccattgttttccaaaaggttcacttccatcagcgttttcatggggggggtacagtatgacattagatacatcattatgaaacggtatatttttcagaattttttctcctatggtacaatgccttcccagcttcgtcaccccgttacgtaaagcgtcattttgaagctcttcctgaatatattgtgccactgcattgtcgtgcagcaatgcacactctgccagatcctgcaggctttgaccctgtatacccatttttttcagcagtacaaaccgccatatatgccacacgtttagaatgattgtttgttactttaatcagctctgcctctacacagtccaatgcatatgagcaggctgctaataaccccagcacatcaaatttcatttttgatcttgtctcctcctttgttctgttttctgagaaatctggaatatgcttaccatgacagatttctcagcctcggatcaataaaagcatatgttttgtcttttctttaatttttccatgaccgttggatattttttataatctgtgtgaggtaaggcctgggcagctaccatctgttccagaaaatcatccacttccgcaaattgtatataagtcatttcttccagtatctgatcaatatctgcaagaagttctttgttcagcaaaagcttttgtgctccttccagcgaagaatttccagcattgatcatcttctcccgttccatgtcaggatacatcccaatggtaatggctgattccacagatacatattttccaaaagagccggctacataaaatcgatctgcctgattcagttcaagtccagattcccggagcatgatctcaaccattatatgtgctgcggctttggtaagaataaattcgtcgatatctttctgataaaaatacagacccggagcatattctatgcaaagctgaccttctcgtttctgaataagattcgttttttcaggagaaaacttaccacgaatatctatccagccttctaaaaaaagttccgcaatcagatcgacaataccggaaccgcagatacccttagggctaatttttcctgaagagttaccaattacatgaacatggatttttccacctcttatcctcacgctgtccactgctccggcatctgccctcatcccggtgtgtactacaccgccttccaatgcaggccccgccgcaccggcgccgcaaagaagaaaatctttatttcctatcacaagttcaccgttggttccaatgtcaaagaaaacactgattccatcctttttatataattccgtttcaatcattccactgatgatgtcaccacccagataattagacttcgccggataacaatatacataaccattcagcggaatgtccagatcttttgccggctggaatcccggacggtctgcatgaacagcatgtggcgtataaaagacacagaaagcatctattcccaaaagaaagtggatcatggtggtattgcctgctactaccatagacagacattttcgtgacaccggatgctttacatccagcttatccatgcactctataatagactcaactgtagcaagccgtatttcttccagttttttcctgtcatctttgcagaaaaaaatacgtgataaaatatcggttccccactgaatctgtttattaaagcagctctcttctcccaatatctcaccactattacaatctaaaagtctcaccactaccgttgtacttccaagatccacagccagcccataatgctgtctggctgtatctccgctttctatatcaaccagctcccatttttctccattccaggaaagcgaaacggttattttccaacctgcacgatcaagtaatggatatagttgtctcaacatgcgaaccggaatatgaacctcctctttcacgccctccgcggataaagcttccagaatgcgctgctggtctgaacgctgatcctcttcggttggaacagaaagatcaagatataattttcggctaagacctctcatagtattcatctccctacaatttgtgcattttttattctgtaaaaaaagaaggtcatttgctgtaacatgccttttcatttcatatacagcatttttcacaagatctttctgaattgtatttcttctgttagtcatttgccctccttattaggatttattcttaattagaagtatatatcagaagttttaaaatatcaatataaaattagtaataattactattattgaaatattagcactttgtaaatgtccctttttcgcacaatcttattccataatttttcgttcaaaaacatattctatttcagatgataaatctcttctaaaattgtatccaagtctgtcaaacgtttgtacgtctgcaggattttcaatttctttttctgccatatatctgaccatctcaccacgagccatcttagcatatgtaccttttgttaccagtttatcccctgattgttcacaaaacgtaaccgtaatatatttgtctttatctgataaatatttttctatacatttcgagtattcttttgatgcaagattaatgataatcctgctgtcatcaagcactgaacgatataatcttttaccacaatagtcatatagatttttggtatcttctatttcagctttcgccttcatctccaggcgatgccttctttcatcagcataatcattgtatcaggataaagttcacaaagtatccgcaatacattcccataagttcatgtcattattgaaattgtacatatttcagtatgaaaagttcaccattcaaattctgattattatttctccacatactcttctgccatatgtactgccatagcaccatctgccactgctgttactatctgacgaagtaactttgttctgacatctcctacagcataaacacccggaatactcgtttcagtgttttcacctgccacaatatatcctttattatccagctctatctgattatctaaaaaatctgttgtcggttttcttcctatactcacaaacaggccgtcacattctataatgttttcttctcctgtgactgtatctttcaaccgcacaccagtcaatcgttctccataaatcagttcatttactgtattgttccatcgaaactctatattttcagttttcatcagctggtcatggtagattttcgttgcacgtaatgtatctcttcgatgaacaatgatgactttcttagcaattcgacttaaaagaacagcatctgatacagcagaatttccaccaccaacaaccaccacgatcttatctttataaaacataccatcacaggaggcacaataagcaaccccatgacctatcaattctttttctttagcgagaccaagttctcttggatttgctccagtagcaatcactactgttttcccaatataaattcccgaactagtttctactctcttaagctttcctgttaaatccatattaaaaacttcagcatattcacttttagcgccaaatttttccgcctgtttttgcattttctctgccaatgaaaatccgtcaattccattttcaaaaccaggatagttatcaatctgccaggtcaatgacatctgaccacctgcagataatttttctaaaacaatggtatcaaatcctgctctggctgcgtataatgctgaagtataccctccaggtcctccccccacgataatcatatcgtaaacatgattttcattcatacagcagtcctccttttatttttccaatgcttcattaataaaattctctatcattatttttgattcaggtgcaacaatagaatctattgcctttccatttcgatataaaaccagcgtaggaatcacctcaatcttttcagcttctgcaatctgtggttcttcatcaatatttacttttccagcaacaagaatatcgctgtattcttcacttattttttcataagctgctccaattctacggcaataaccacaccaatgtgcccagaaatcaaccaaaaccggtttttccttatgaattaattgtccaaacttttctttatttatatttatagatgtcatatttttcaactccttctcctatttgaacttaatataccccaaataagtgcttgcttccgtgatgatatcacagaaaagataatttactttattacacttctttttatttctatttatggcatatgccagttatataattgacgcatctaaaaaaagcaagtatactatgttcgtaaaggagataacggttatgaacttcgaaaattgttttccactatggaatgacttaaatacagcacagaaaaaactaatttcagacaatttaatcacacgggatgtaaaaaaaggaacgatcattcacaatggaaacctggactgtactggattattactggttaaatccgggcagcttcgaacttacatactttcagatgaaggacgagagattacactttaccgtctgttcgatatggatatgtgtcttttatccgcctcatgtatcatgcggtctattcaatttgaagtaaccattgaagcagaaaaagatacggatctttggatcatccctgctgaaatctataagggcatcatgaaagaatctgctcctgtcgcaaactataccaatgagttaatggctacccgtttttctgatgtcatgtggctgattgaacagattatgtggaagagtttggataagcgtgttgcttcatttcttttagaagaaacatccattgaaggaacaaatgaactgaaaatcactcacgaaactatcgcaaaccatcttggttcccacagggaagttattactcgaatgcttcgatactttcaaggcgaaggactcgtcagactctctcgcggcaaaataacaatccttgattcgaaaagactggaaacactacaaagatcataaaacgtttttttctctaaagaatcctccatttatcagaattatgaaagtcattctaataaatgggggatctttttatactacaatcaaactataaaaatattttatttatttctaataatccataccacatgcatatgatctttcaatcagtgcatggtcattagccactgcatcataaaagcggaatccacctgaaaagttgtatgtttcatatccatttccttccaaaatacggcttgcaatataactgcgtagcccactctggcatatcaggtaaacaggctttcccttctcaacttcattgatacgttccctcagttcatctacaggaatgtttttaaatccattaatatggcccctgctaaattcacctactgttctcacatccagcaacacagcatttttatctttagaaatcttatccatatcttccaaatgccattgttttaaggttccttttgctatattgtctatcatgaatccggccatatttacaggatcctttgcagaggaatatggcggtgcatatgcgagatccaaatctttcaactgggttgccttcagtcctgcatgaattgctgttgccagcacatcaatacgtttatcaacaccttcatatccaataatctgagcaccaagcaaacgataagtctctttttcaaaaaccaccttcatggtcatcacttttccaccaggatagtaaccggcatgactcataggagaaagaattactgtatctacatctaaccctgactttttggcattggtttcattgatacctgtagtagctgctgtcatatcaaatactttgataacggagcttccctgactgcccaggtaacgactatcaccgccacaaatattatcagcgatgattctgccctgtttattggctggtcctgccaaagaaatcagcgcatcattacccgtaacataatgttttacctgaactgcatcacctgcagcataaatatccggtacagaggtttccattctgtcattcactacaatactttccttgatgccaagttccagaccggcttcttttgccaatactgtgtctggtatgactccgattgccagaactaccatatcagcctgaagggatggattatctttcaacaggacctccactccgttgtctttttctttaaatccttctactgtatagcccagtaccagttttatcccatgctttctcatttcattatggatcatggatgccatatccgggtcaaaagggttcatcagctgcttaggcctctggacaatcgtaacatccatgccaagctccctcaaattttctgccagttccagaccaataaaaccgccacctgccaatacagccgattttgaatgattcttatttatatattcctttatccgaaaagtgtcttctacagtacgaagtgtaaaaagtttatcaatacctactccgggaagtctcggctgtgttggctttgcacctggagagaggatcagcttatcatatttttcttcaaatatctcaccattctctaaatttttcactgaaaccgttttacgttccggatgtatggagataacttcatgatgaattttcatgttaatacggaagcgtttaaaaaaactctctggtgtctgtagtgtaagttcttccgggtctgtgatcacgtctccaatataatatggaagtccacaatttgcataggatatgtatccggatctttcaaacacagtaatttcagcatgttcattcagtctgcgtattcttgctgcggctgtagctcctccggctacacctcctacaattattaccttcatcttatttttccacctttcctgagtaagctgcaatgccaccgatattatttactttagaatatcccattcgttgcagtatcccagttgcctggcggcttcgtgaaccggaataacagtatacaaacagtgggatatccttattcttcgctacagaagcaatattgtcaagttgctgcaacggcacatttttactttctggtatatgtccttcctgatattcctgcggtgtacgtacatccagcagaactgcatcatcagtccttttatattcttctatgccttgattaatattcgactgtttaaagagatcaaaaaatcccattagcacacccccctaaagcatttctaaaatcgcattcttaggtctcgcccctgaaacctgctgtacaatcttcccattcttcataaccactaaagttggaatgctcataatactgaacttatttgccagttcaggctcttcatctacattaatctttccaactttaatatctctacgctcacttgcaatctcctctacaataggtactaccatacggcaaggcgcacaccaagatgcccaaaaatctaaaagaacgggtttatcggaattcagtacttcgttctgaaaattatttttattgatattaatagcagacattttacagtcctccttatctttttctttttgtagatttattatagtcttaatttcatttattttccgtgattacatcaccatacctcattaacttaacttcttgccataccatctacacttaatataacacctgtaatgtaactcgcctcatctgaagcaagaaacacaaacgcattggcaatatcttctggctgtccaagacgacgcaatggaattctttcaatcataggttcgataacttcctttggcacggccttcatcatatcagtttctgtaatcccaggtgcaacagcattaacacgaatacctttaggtcctagttctcttgctaatgatacagtcaatccgtttactgcaaacttcgatgccggataagcaaacccacttggctgtcccgaaatactcaccatggaagaagttgagagaatgacccccttgcctcttgacaccatacattctgctgctacacgagtagtattaaatactccttttacatttagatccatgactttatcaaaagtctcctctgtataatccataaatgaggtgttttctgaaatccctgcattatttaccagtatgtcgacacatccatatttttcagttgcctctttaaaagcctttctgacagactccatgcttgctagatttggactaattccagcaactattgcattgggatatttttcttttaatttatctacagcaacatctgccgattcctgtgaacttgctgccaacacaactgaagcaccttccttcaagaatttatcagctgtagcaaatcctataccacggcttccacccgtaatgattgcaactttatcttttaatctcatttagactacctccttacttagtttctaactacattataagcaaaaggtagattattttctgtgatatcatcacaaaatatcgcaataaaaaaccctgttgctcacgcaccagggttttggtttatccatccgtatttaacacaagattaggcttctattcaacttctgaaaactgatcttttccaacattacataatgggcattcaaaatcttccggaacatcctcccactttgttcctggtgcaataccaccttcaggataaccttcctcttcatcatattcccatccgcaaacgtcacatacatatttcattagtttattcctccttataaatatattaatacacagcatatattactgttgtatttgtgttgttctgtaaccttaatatgtataaatgcttttagcatttccataatccatgcaggttacaatatgcatatacttcttctacctgttcaccattgcaaagacaaaaatctgctaccggctcctgccctggatttaactgttttctgtatattccctggtttgtatttaatgtaatccactcaatgaaatgctcttcaagcattggatgttttgtctctccgaccacgacatgaacatgactgccttctatcgtatatacaggtacatgcttctcgacagcagcatctgtcactccggcttttaattcctgcataggttctccgcaacacattactggtacgccttgatcctttaccatttcaataatgtttccacaatgattgcatacagaatattttacttccatcttttttatcttcctatgtttaaaatttaaaatccaattgtttctataacttttttcaaagcatccaccgattcttaaactttaatgcttctttaccaactgatgcagaaccaacaaagccacagcctatcattactgctttttttaataatcactttcttctttgtaataatctccttctctttaatagttctcttcacgtatttcgaaataactctgtggatggttacatactggacatatctcaggtgcctttgttcctaccacaacatgtccacagttacggcattcccataccttaacttcactcttttcaaacacctgtgcagtttcaatattcttaagaagtgcacgatatctctcttcgtggtgcttctcaatctgtttattgttaataaataatagtaatgattactattattataataatcaatattactgattaccttttatttaaaataatcattcaatcatcattttttccgttcaaaaacatattctgcatctgatgacaaatcagagcggaatgaatagcctagtctatcaaatttcttaatatcctcaggattttcaattctgttttcagccatgaacctaaccatttcaccacgggccatcttagcatatgtaccttttgtcaccagtttatctcctgataactcacaaaatgtaatcgtaatgtatctatcctgtcgtgtcagatatttttctatgcacttagagtattctttcgatgccagattgattataatcctgctgttatcaatcactgagcggtataataaatctccccagtactcatacagattttttgtttctcctattccaaccttcgcctgcatttccaaacgataaggtgtcacaccatcccttggttttagcacaccataaaatgcagatattattcccaaatgattttgtacatactcgaactgactgtcctcaaacacggatggagccatatattgaaaagcaattccttcatatgataagacagctggggtaagtaaatgataaagatccatgttttccaatctattgaagttctgttctgtaattttgtcattacatttccagatagtcttcagttcttcttttgacttacttttcaaccaactttgtatctctgtcgtcttttcaataaattcaggcaatccatccggcgctatgctgtcagtatctgtaatcatctttttagcaggggataatattatcttcattaatctaattccttgagcatattttcaggatcatctgcagccttgactttatcatttgcctttataataatcccctgttcatcaataagatatgtggttcttactactcccatagagactttgccataatttttcttttctttccatacatcatatgcttcaataactttccgctctggatctgctaaaagtgtaaatgtcaatccatatttttcttcaaatctcttatgagaggatacagaatccttactgactccaagaataactgctcctttttcggtaaactgagggtatcgctcagaaaaaccacatgcctgtttcgtgcatcccgctgtattatccttgggatagaaatataaaatcactttttttcctgtataatccgataatctatgtattttcccattttgatctggcaactcaaaatccggtgccttaacccctacttccaacattatttatctctccctttctgtatctttctctttattcgcctttttcttcctattcccggtaatcattttatgacctgtatatatcgccattaccatacataacatagaacttaaagcaaagtatttgtgacttgatttttgctttttatatccagtgtaaaaagtcccaagcatcgtgatcaatgctcctactgaccaatatttatgtgctttcatgtaattcctccattttttcagtgtattcaattctaattatacgctaccatattcctatgtcaatttgataatagagcattcctataaattttttcaaaatatcattgtcaaaactatgtattgttatcctttaatttttctttgaaataattgacaaaaagcttgctttcaggagattactatttaatctcttttccatctatatatagttgaaatttatcaggattattgacaacatcatagtcctttccgtattctacaggtctatattcggctgtcattaccaattccccgtcttcaatatcctctttccttaaatagatgttcatatcaatgctcgtcgcatatcctctgtctgtggagaattttgtcgaatgaaaagagactttacaacttaaaattgaataaaaaggacaaaaaagaagagctgcttgctcttcccatatagtagtagtaaaataatatgtcatgccagcgcaatatattacctagaatatcgctataacaggaaaggggctgcattgtgacagcccctagtttacttcatcacgttgtctacattctgaatgaactcgttccctggtttattttagcatcggtctggattttgtttcataaagataaattttgccacagagcggtcgtatgttttaatgtgtccaaacagccagtcgattacatttttctgtacaagttcactgaaccgatctgtcggtccttcatactcctgaaggtattcatacagttcctgaattgtctttctaaactcttcatgtttttcataatgtttttcacgctctggataaccggatttttcctgaagcttttcctcttctttgaaatgaaagtcagtatattcatccagataatccagcattttgattgcttttactttgctgtcgccattttgacaggcagttacaaagttctggatacggtcgatcaattctttatgctgggtatcaattgtttcatttcctgttactaaattgtcatcaaaggtaatgtttaaatcgtaagtcataatttgacctccatttcttttatatgttctcttaggctcttttaatctctggcagtttcgtacctgcattttctgcttagtcttctacaggaacgaaaacatcttttcctaatccgcagattgggcatgtccagtcatctggaatatcctcaaatgcagtttctggatcgataccagcgtccggatctcctactgccggatcataaatatatccacatggttcacattcctattttatcatagtcattttcccttttcaatatcgatttatttttgttaccaagttcctagcaatttttctaacactttgtttcttgtatatttgtattatacatgataattatcctcttgtcaataatggtaattattattattattattttgcttagcataaactatatttgaattgcaaatttacatattgtatatatcatgggaatagttgaataaaaaaatgaactctattcattaaagacagagttgaaacctcaaacaaaaaataagcctgccatcatccgcagatttctccacagacaacaataggcttcctactatctcatcaactcattcacgattgtcaacgtgttgcgatgaatttcaccatacttaagatatgcatttataaaaatataaggcatccaagaatatcccagatgccctatcgaaaatgtgttttttatttatatagtcacttctattccacctcgaaaaatcaccctgcagctcttgtccttttcagctacaatctcatccagaaggccaccccaaagctcctctctgaactccacctgctccccatcaaggtcctgcagattcatgatgaagtttgtcaaaataccacgcttgtccttccgctcctgaatcatatcattcagttcgcctaacttctcttttttcttttcgtaaagattcctcaaagtatcttcctttttttgatactcttcctgatcctgcacaatccttgtattttcccggatgacactattgattttttctgtcaaaagctctatttccgcttccagcctttcctgctgcacttctaattcatccgtctggcaggtatcctcgatcagctccttcagattgtcaatgcactcttctttttcttctatcagcagattcagtgccttcataaaaatttcttttagttctgactctgaaaagtgtggagattcgcaaggttccttccccttctggtatttcttattgcaacgataaatgactctccgatatttgtcttgggaatgccacacctttgcaccataccagtttccacagcatccgcatctgaccttatttgcaaaaatatccgctccactgtatcgtcccatcttacttcttctaacaatttcagcctgcacataatcaaatactggcggcgggatgatcggtttgtgatgcccttctacataatactgtggaatctcaccttcgttcttcttccgcttcttctgaagaaaatctgtcgtgtactgcttttgaagaagtgcatcacctttatacttcttatttgtaataatggattttacagtgctggcataccattttctccttccagcggggcttgggattcctcttcgttccatttcctgagcaaccccataaaatgtttttccgctgataaacaaccggaagatcagccggatgattttcgcctcttcttcattgatttcaaaatccttatcatacccgaggaatctactgtaagccaccgctccttttccatcagcaaactgttttctcttgccccaagtggtattctcagaaatgctccggctttcttcctgtgcaaaggaactcatgatggtcaaaagcatctcacccttggcatccagtgtccagatgttctctttttcaaaatatacctctacacctttttccttcaattttcggatggtggaaagggaatctaccgtatttcgtgcaaatcgactgactgactttgtgataatcaaatcgatcttccctgcaagggcatcctctatcatctgcttaaagccatctctctttttggtattggttgcactgattccctcatcagaatacattccaacaaattcccaatcttcccggttctctatgtaggctttataataggccatctgagcttcataactggtagcctgttcatcccgatccgtggatactcgtgcatatccggctacccttcgtttccttatcgccacgactggttccaaattgaatctgtttaaggtagcagggattttcgttattttctttgccatgttgtcgcctccccatttttgaatctgaactcgatgctgtcacttcccacaaccagtttctctatatcccgtacaacggtttgctgatagggattttctaaaaccatttcggcagccttcagaagatcttcttccgttaaggcccgaaccttatcttcctggtaatgacgtttcgaacaataccatacttttttcccttggtagcccttatctctttggcatttttctccgcagctgcaccacaccttattggtaaatgcattctgtcctctcagtccgttgaactgccggatataatgtttaactcccctagaagtcaagaactcaagccgatcactatacactgtgacctgtttcacttccttcaaaaacttttcttcatcaagttctgaagttccaaaaatctgtgcactggcctttatcagttcctcttcccatattggtcggcagtcacaaaactttgcaccttttctttccctggtattgcaaacccatctctttcttgtagctgatgttcttcggctgactcccattccgcaatatccgcatttcatcctgccggagaacaccgtcagtttcggatttttatttgcctgccgctctgctctctgtgccctgatctgctgtgccttttttaaatcctcaactgataccagtggctcgaacatctcttctacatagaacatcggcaattctcccttgttcttcctacgcacatgattttctgtaaaaaagtttttttgaaggatcatggtccccgtataggaaatattggaaagaatatcctttaccgaagtctgctcgaatggtccgccctgttgcccggttacacctcttgcggcaagatcctttgcgatgccatatgctgactcccctgcaaggtatcttctgtaaatctcctgtacgctcacaccctgttccgggataatgcggaacatctcaactccgtcccaccgatatccgtatggtgctttatgtccattcggaattccctgttcaaatttctttcggatagcccatttgatattctcggagatgctccggctctcttcctgtgcaaaggaagccagcaacgtaagaaggaattctccatcatacgataatgtattgatctgttccctctcgaaataaactgcaactccgaggtctttcaaacgccggatggttcgcagggtatcaaccgtatctctggcaaatcggctgatactctttacaagcaccagatcaatctttccctgctcgcagtctgcaatcagtctgtggaactcctctcggttccgggtactcgttccgctgataccaagatctgcataaataccagaaaatttccattcaggatttctctgtatcaagtcgttgtagtaactgatctgtgcagaaaaggaacgctgctgttctttctcatctgtagaaacacgggcatatgccgctactctcagttttggcttcagttcaacctttttgggcttaatttttataattttcggcataaagccatctcctttcgcagtgacatattcgcgtactatccgcactatagcaagtccatttcggcccataatgtgccgattataggcgcgtatttctgccgcatttttgtgtcatatttctgatactgttcttcggtaataagccccttttccaacatccgacgtgctgcactcatggtcatctgatacacgacttcttttcttccctgttcccttgtcatacctcatcacctccgaatctggctttgatgtagcatgcgtgggaacagtacttccgatttgcatttccatacacggaaaactgtttcttacataccgggcagacaaagctataattggctttccgttttacctgatccagatgactgttccaccatttcatacggcatttatcggagcagaacttcttcggcttccttcccggtatcagctccatcacacttttgcagcacggacaatactgccttttcccctcagatgatgccagattggttgccactcctccaaggccatgcctccggcaatatgtcttgatggtgttttcactaatttcaagtatttgtgcgattctgccataaccatagccttcttctctgagttccctgatctgctgtctctgtctatcgtccatgtcctttacctccatcaaatctgaagggaacacttctgtatctctatcgttatagcttttcccttcactatcccatggacacgaaatcgttaaatgggcggtaagaaatttataaaatgtgcatcccccttccttttctcctgttttcgagcaaaaaaataggctctgcactacgacgtaccgtaatacaaagcctatttctttgattcttatttaattatcctcaaccatctcatcatcgacatacagatggaactgctctgtggcattcacaatatcatattctgcattccattcttccggtttgtattctacagtcatgatgggatctttttcccctatatcttcctttctggtataaacattcatatccagactggtaggatatccttcatcctcagaaaacttcatggattcaaatgaattttctttatacatctgaagcaaaagcctcgcaaatgcctctttatcctcaatcttatcctgatttgctacaacggtaagcatttcatcccggttcattttcatactgcctacaacatccgggactgctgcctctgccttaccacaagccgagcataccatgattgtcccaataatggtcataaccaccgcctgtttcctattatacttcttcacacgtttcctcctccatacacaacatctcaccaacaagatactggatcagttcttctggtgatggtttttcaccctcatagggtaccctcttccaatttttttgcacctcttcatccgaatccttcatccccacatcaatcactttctggatttctgaatagacctccaaagctgtggttccatgtttcttagcaactttctccattagttctttaaattccatttttctccacctgtagatttaattcttgttctatagaacaatatagcataatcaaacaggtattgaaacaaaaatcgttcgacatagttctacaagaatttacgaaagtacaaaaaaagaagggcttctcagccctccattacttgctattcctgcacatacgcttctattgcacgtatgactcttttttgctctttcggcggcagtttcatgatgcttgctgacagattgtttaccacaccatttacagactgtgccacaacgtccctcaaaagactatccgctgaaacatccagtgcatttgcgattgctacaaacgtatccagttttggtactttctgaccacgctcgatcacactgatatgtgtcggactcaaatctaccaatgcagccagctcttcctgtgtgagtcctttggtctctctggtttccttgatacgcagaccaacatctctcaagtccattgcaacacctccttcagaactatttataggtctaaagatattatatcggttacccatttcggtatacagaatctgcaaaactatttcttgttctaaagaactatatttgctgtaaaaaaacaaaaaaaaggctctgtactacgatgtaaaccgtaatacagagccatctttcttaatatttcgttgcaaaatccaaagagatccacccgttccgcttttccgtataagacttcaagagtccccatttcgttgctccagggccgtctgcctcatccacgatggtaaagaccccaatccctgtgaattttcccttcgcataattcgtaccaggacccttacgaatatagaggtccttaatctttacctgcacagtatacggtgtaaactgctgttttgctgcatacaccaccactccatttccatcaaatacagaatagcccggatgctcatccgcacatttcttcgcattagccagaatcttataggctccaagctggctctttgcatccgcccaggtcttgcggacacggtaatataccgtactggtctcctcttttgtattcgaatctgcgttatacttggtcagctcccacttttcaatgatttcacacaaccgctgcacataggtgctggaagttgcatatccaccatccttgatgatctgcgctgccttcttataattcgtacagcccttcagaccatgataccgaagcgtggagccgttctttgctccaagcaaatatgcggaatgatccgcaatggagtcctcgattgatggatactttcggaaatctgctgtgatggtgatcatctttccgttttcttcttcctgcgttttcttggtatagatgctctttccatcccaggaagaatttccccaggtattgccggacagggatttcttcataccaaaacagttgttggctccctgtgccagctcactctttccatagccggattccaaaatgaactgtgcaagggatacacaggccagctaatgtcattaacttaagaaaatttataaaataaaacagaaaaaggtcttgacaaatgtcagaaaaaatgtggcgaagcctccttgaatgaatacattttaggaggaattgctaatgaacttttacgctgattatgtccgcaacaaactcaacgctgccatttccagcatgtccagtcagatagaagattacgtcaaaaatcccgggcatgattttaccagaaatcggaagatgaactttacctcgacaataaactttctacttactatggaaggtggttcacttaactcagaattacataaatattttaattatgatctgaatcaaataacccgttctggtttcataaagcaaaggaacaaattgaaaccagataccatggaacatttatttcacaaatttcatgagcagatattatgtaacaaaaaataccaaggctatcagttacttgcctgtgatggttctgacttgaatatatttcgtgatccactaaatccacacacgtattttgctggtaaagaaggaacttttggttttaatcaactgcatcttaatgccttgtatgacctccaaagcaggcgatatgtcgatgctctgattcaggagccttatgaagaaaatgaatcctctgccatgattgaaatggttaaaaaactgactacaaatcagaagactatcattatggcagatcgtggatacgaaacttataacatttttgcaaatgttcaggaacgtggtctcttttatctgatccggattaaagatacctcgaaaaaaggcagcatttccggaagcctttccttgccggtatcctgtgaatttgacgaagaaatcgaactgattatgacccgtaaacaaaagtcttataaaacgaaaggttataaatatctctcaaattcatcgccatttgactttcttgattctgagaatttgttttatacacttcatctcagactcacacagtttcagctggaaaatggagtttatgaatgtatagccagcaacctggataaagaagaattcccacctgaaaagatcaaggaactttatcatatgcgatggggaatcgaaacttctttccgtgagctgaaatatacgattggcctgacaaatcttcactctaaaaatgtggaatatatctgtcaggaaatttacgcaaaactgatccagtataatttttgtgaaattatttcagcaaatatcatactggaagaaagaaaccgtaagtacacataccaattaaactacacaatggcaattcaaatatacaggcattatctgcgccagacattcgtaacgatagatgttgaaggtctgattaagaaagaactatcgccccaaagaccacaccgacaatatcagcgtcgagtaataaagaaacgatgggttagtttcgcataccgtataggataaaaaattattcaaatgaatatagctggcaaaaagcagacttttggtttgtttatttgttatgcgtaaatcttgtgatttttcaagaaagctaatctgaacacttattacaataatcgaaattttcttaagttagtgacattaccgtttcagggcccccttgcaatgaacatttatcgcatttcttggttttgcatatcccaaagcaaatgctacatcaattccagaaaataaaagtctgcctccatcttcaatcatacggatggaaccaaactccgaattgtgaaactctgtgattttataatccgtcttctccatcctcttctcctcctgcaccggcaagtaacatcaaaccattttcaatgattgtgctccgaataaactctgctacattcacggttaaataaccaagatattctgcaaggaaacctctatattcctcttctgtcagtaattcctccagtgcttccaaatgagctgtcactttagaagtctgttttccgccaagcagcctgcctaatatttctgtaaattcctctgtgtcacatgactcaaacatacataagatcatctccattgttgtttccaaaactaaacgatccattttcatttttgtcagctcttccattgttttcatggaagtcataagcgcatcacttatcatatgttctgaattgattcttccttctgaatcaactaatcctattgcaaataattctaaaaagtattttctcataaatcttgtcctcctatcgaaatggcatttcttgttcaagttcttctggtatatcgaatggaatcttcctcttctctgctggttgaaatccatcagattcttctttttttgttttggcttctgcaaattccacatcatccataatgacttcggtataataggatgcagttccagtctgttcatctttgatctgagagattactaactctccggaaagagcaatcttaattccattttcaagatatttctccacaaattctgcattatttccataagctgtgatcatcactacaaatgctttggttgtgcgatttctttttactactagtggaaacctggatactttggtttgtcccttttgcgtagatgccagcttagtttctggatctctggcaagcctacccattaaaacaatcgtattcatgcttcttgtccttcctttcctcctgcaacacctttccctggtatttcaaacaggataataatctatgcattttctgcacgaaaaaatgaggaatggagtcgaaccattccccacttgctacaggatttctcctgtaatataaataagaaaatctaagtattcgcatttgggctttgtctgtacatatacatctgatcgttatcattccagataacccggctgcaaaaatacagtcacagtctctgttttagcagaggtcctgtacctttcggtggtatcattattgcttcgctcttcccgtaggagtcttcgcctgcacgagccggattatctccggtaagcatgttcctcaagatgtatcagctccttcaattgtcaaggtgcaatcggaagaactgtctgaacctcttttatgtttgtgatttttggaaatcagaggattttcaatttgccttccatatactctgtattgggagcgacaaaatcggacatgattttagaaagtttttgaaattatttttttgaagtgtaaaaagacataaaaaaagatgccaggatttctcctgacaccatagttactgtgccaacttcgtgcccagtgggcacaaggttggtaatcaactattattgccatctatatttcaaataaaaaaacaccctcattccggtcattaatccaatccgaaaatgggtgttttctcatacctcaactctatgactatattctatcaatttttaagtacctctaatatttttcgatctataatttgaggtgtccggatttctcccgacacctcaacaactaacactacattttcaatcagactactttttattctttggctttattccccagaataccacattcataagtattacgatcaacagcacagcagccatagatacccagaatcccatattgagtccgagccattcacaggttccaaaaagtgtcatccataattctttccaattcattctttccacctcctagagcagttcgccataatagcggacatatgcttttttcaagcttgttgccagcatcatatacagcagaatacatgggatcagatatgcaaagtatgatgccggtaatgctatcagaccaagtgcagttccaaatggtgtgaacggaatcacagtcagaactgcaatacctgtcatggtaagcaatgttaccggtgctgatgcacggctctggataaacggaagctttggtgtgcgaatcatgtgaatgactaatgtctggctccacatagattctacaaaccatccagcctggaacattccgatataacgtgcctgcatagcagcaagctctgcaccgctgtaatgggctgccaaatcattgaacaggatgccctttgacacaaataacggacagaatacaaagtacatgaaaatataagttgtaaaatcaaaaatcgaacttgtaggtccaatccagatcataaagctacccacactggatgcatcccatttacgtggtattgcaataaattcctcatctacattgtcccaaggaatcgctgtacaggacagatcatagatcagattcaggaaaatcagatgtacactcatcattggaaggaaaggtaaaagtgcagaagcagctaatacagaaaacatatttccgaagttagaggaagctgtcatcttgatatatttgatcatattggcataagttttgcgtccttctatgattccctcttccagaaccatcagatctttttccagcaaaatgatatctgcggattcttttgccacatctaccgcagtatctacagaaattccgatatcggcagccttcatagccgcagcatcattgattccatcacccataaatcctacggtatgaccgttttccctgagaacggaaaccacgcgagctttctgatccggtgtaagctttgcaaatacctctgttgtctctactgcttttgcaagctggtcatctgtcatatgatccagatcagagcccagaagcatgttgcttacttcaagtcctacctgtttgcagattgtacgtgtcaccttatcattatcacctgtcaaaatctttgtcgttacgccgtgtactttcaatgcccggattgcatctgcagtagactcctttggtggatcaaggaatgccagatatccgattagtaccatctcacactcatcttttataccaaatgcacccactggagaaggattgcttttttgtgctatggcaagcacacggaatcctttgtcgttcagctcgtctaccgttttcagaatacgcatgcgaacttcttcagtaagtggcttcacagtgccatcacactccgcaaaagaacagatggatagcatttcttctacagctccttttgtcaccatctgtgtctttcccttcttatcctgtactaccgtagtcagacgacgacgtgtaaaatcaaatgggatctcatctaccttcacatagttttctgacagatcgaggagctttggatctgccgcctcttcttcctctgttctgtgaatgatcgccagatccatcaggttcttataacctgtctggaagtagctgtttaaatatgcatggcgcagtactcttgtatcatcttctccattcacattcaggtgatattccagcacaaccttatcctgtgtcaatgttcctgttttatctgtacaaagaatatcaatggcaccgaaattctggatggaattcagattcttaacaatcgtctgctttttgctcatggaaacggcaccttttgcaaggcaggttgttacgatcatcggcagcatctccggagtcagtccgacagctatggaaataccgaacagaaaggcatccagccagtctccctttgtgataccattgataaaaaataccagcggaaccatgaccagcataaaccggatcagaacccatgacactgcattcacgcctttggtaaagcttgtctccactgcttcacctgcaattgcagatgccatggaaccaaataaagtgcggtctcccgtgcagataaccactgctgttgcacttccggaaattacattgcttcccataaaagcaatattgctgtaatcggtgatgctttctttctgtgcacataccttcggtgtcttttctaccggttcactttcacctgttaagcttgcctgactgataaataagtctttggcatccagaatacggacatctgctgggatcatgtctcctgctgaaagatgtacgatatctcctaccactagatcgtccataggaatctcaattttttcctgttctcttcttgtaacggtacaagtagttgtgatcatggataacagtttttctgctgcatttccacttctggattcctgcacaaaacgaagcgtaccggagatcataaccatggtcagaatgatcaccactgttaatggatcaaaatcttccggtgaacttcctaacagagaaaaatatggaaaaaccatatctgtcatagtagaaacaactgccagacagaaaaggatcgctgtaaatggattgataaatgctcctgccagacgtttcacaagggattgtttcttctcatgtgttactttatttgatccatattttgtccggcttaccgctacattttcagcatccagtccacgaagtgttgtgtgcagactcttcaaaacctccttaatcggattggtggccgcatgttcgatgcgatggttctgctcgtcacggatcacagcctgctgtgctgcctgacgaacagccatacgattttctttcttattcattggtctttacctccttgttttgcaattattttttatagtatcgatcacttttctcgatataccaaagatcaaatcctgccacaataaaccatgcgatcatagcagtcacaaaccagtgattttcaaagcctgaccatagacctttcagcaaaaaaatcaaaccatttaatgcaatgacttcaccgatgttacggcaaagcggcacaattttgatcttttctttctcttcctgcggcatatttttccaggaagataaatgaatatgaccttttccacatgcaaacataaaaccgacaatcgtgaaaatgatgccaaaaaagatacaggttaaattcatggttttcttctcctttcattgattcatctcattctgagcttatttattttctgaagcctgataagcaatttcaccattgtaactgccaaaataatccaaacaacaacagatatttgataccagacctctatcaccaaaatttggtgagccgaaaatataaggctcacacaactgcatgctgcagtgaacaaaatataaagaaagaaaaaaattatccatctatcacatttgttttttttcaactacaacacctcccaacctgcactgattacttccggaagttccaatgcctgaccaacaatactttccagaacattacttttcggttttcctgcagaacaatacttcgctataatctcgactttatcccccactacatctccactttccagatgattcagatacaaagtcttactggaattactgttaatcagtaaaagtcttatatcctgttctgcaatttcctgacaaagtactgtgatgcagtattctttttcagattcatctccaacagcaatcggattcagctttcttgcaagcggacgcaggatcagatttgaaccaatcaaaatgcctgcagcggagactgccattgtaaacattcctgtgctggcaagaatgccaattgccgctgtacaccaaagtgttgctgctgtgttcattcctcttaccgtaccgctgtctttaaagatcacaccgctgcataggaatccaacaccggagataatgctgcttcctacacgaaacacctgatcggaaccataaagcattggaaataaagtaaaaaaacttgttcccatacagattagaacattaatccgtattcctgctggatgccctgttaactgcctttccagtccaataaaaaatccaagcaacacggataaggaaattcttaatacaaaatctgtgtataccatacataccgcctcccttcgactcctaaagaatacaaaaaaagcaaggagaatcacatgaccaaagtcttgcgatttccttgcgatttagcaagaattataaaaaatttggcggacttaaatcagcccgccagttttacaccttatcattaaatttatatccgatcccccaaatcgtaagtatatactttggttcatccggattcggttcgatcttctttcgcaattttcgaataaatgccataatattactgtcgtctaaaagatagttttcagaccataccgccttataaatctgctcctttgtaaatacttctcctctgttttcagccaggaaatacaggatatcaaactccttaggagtcagggaaaccgcttggtccatccttgtaacgctcctgcttttcggattgattactaattccccaattttcatttcatctgaaagattgagagatgcaatttctgaattctttacagtgctgagcagcaatgaatttacctctccactcaccatatcataaataccggaaagcagttctttcgcactgtcactatctggtggttctttgatcagcttttgaatgagccattcctgcaggacagaatccatggaaataacactgatattctttttcacgatgattctcctcctttcagatcagctcatgatatttcttctggtaaacaattttgactactgtagtcagaaacatatagagtaggactacgacaaataaaaacaggaaatacctgattggcaatttcgtcaatccaataacacctgcgcctttggtaaaagtaagtgcagtaaaggcaataattcctgcaaaggtcgtacaaacaaccggaatggaaggactgctctgtacaaatggtatcttccttgtccgaaggaaatgaaggatcaatacctgcgtccacatcgattctaaaaaccatcctgtctgaaataaagcaacatactgtgactgcatcactgaatctactatattcagatacgttgctccaccacacaacaccggacataaaatataatacaaaaataaaaatgtcacaatatcaaataatgaactgataggaccaaaaaacaacataaaccttcccagtgtctttccggaccagtctcttggagatagtgtttcttcctcatccacattatcccatggaaggataatacataaaatatcatataacagatttaataataatatctgcaaagatgtcattggcaaaaatggtaagaatgcactggcacaaacgatagaaaatatattgccaaaattggagcttgccgtgatcttaatgtatttgagcatattcgtaaatgtcttacgcccctctaaaattccctgctccaatacgcccagatccttttgaagtaacaccacatccgcagcatctttcgcagcatctaccgcagtatctactgaaataccaacattcgattcacaaagagccggaatatcattgattccatctccaaggaaacctaccgtatgtccattttgccttaatgcagatacaatccttactttctgtccgggtgtgagttcagcgaaaacatgaatattttctactgctttgccaagttcatcgtccgtcatctgatctaactcgacaccagtcaatatgatttcagaagagattccaactctccggcatatagaagccgctacgtcagcctgatcacctgttaatattttcggtgtcacctttagtttttttaaagtctccacagatgtcttagctgtttttttcggagcatcaaagaatgcaagatatcccatcaggatcatattattttcgtctgtcggtatgatctggtcctgtttctcaatctttttccgtgcaacagcaattactttcattccatcctgcagcatctcatccactacagaagctacgcttaaaattctgtccttttccatcggaaggatttcgccacgaaattccacatgactacaccgggacataatctggaaaatattacccttcataataagctggcaatctccatttttatctgtcaccagcgtactaacaaatttgcgggtataatcaaatgggatttcatcctctttctgatactgcgtgagaagaccagcaaaatgctgctcatgcccaggcatcgtctgacatgcaaggattgcgttatcaatcggattacatacaccagaatgataagcactatttaaaaaagcaaaatccaatacctgcccactttcgtttcccagcacatccatatagtattccaataggatactttcattggtcagtgttcctgttttatccatgcagagcacatccatgctgccaaacccttgcattgcattaatgtctttaatgattgtctgctttttactcatactcagactgccccttgcaaggcaggctgtgattaccatcggcagcatttccggcattaagccaacggcaacagacagagcaaacgcaaaggattccagccacctaccaccggtaatcttcaaaagtataaatacaataggaattaataccgcaataaaacgaagcatgacccaggcaattgagttggctcctttttgaaaagactgtttttcatctggttcttctttcgtaaaactgccatatagtgtgtcttttccgactgcaagcacaataccctcaccttttccactgatgaccgtcgttgccataaatgcaaggttttcaagccgagtcaaggattccgaattactgtaactcagtgcctgtgcatttttttccaggattgcactttcgcccgtgattgctgcctgggaaagaaatagatcacttactttggtgagtctcagatccgcaggaatgcgatcacctgccgcaagcagaacaatatctccaaccaccagttcctcagctggaatctctttcacttctcccgcacgccgtacggtaatgctttcatgtatcagctggtttagctgttttgatgcattctttgcacgaagttcctgaaccagacggattgttccgctaatcaaaatcattgaaaatatgataaccgcagtcgttgcatttctggcaaaattcgatacaagaaccacgtctgtagccagtgaaatgattccaataactaaaagaatgatattaaatggattgataaatgcacgccgcaggagtcgtaacatggtgtcatttcttctttgcgagaaactatttataccatacttcgccctcatcaattcaacctgtgattgtgacaggccttcccctgatatctctaattcctgatatatttgtgatacttctcgataagcatatttcttaatacaacaatcgatcagtgtagttttaggcatataggcttgcctcctttctcaataccgatatatttattttaacattatcttaaaaaaactccatgcttagattcttgcttttttcttgcgattacattgataatcaacttctacaccgcacctctttaaaaatcaataaagccggtactggatatcaaaatcctgcaccggctttatcgatttaattattctttagactcaaccgattggcatgcttgcaaacttgaagttaaatctttgttttaataccatgttatattgtcaatttctttcagtaaattttcccaatttcttttttcgttccatttaatttttccttcttcaatggaacctagctctatatcaaaacatttttcattgtcattaaagaatttccagttcaacccattggtatatataacttttccaaacgacttaatatgcccaagtaattgttcatcgttatcacctaaagctattgttggcatttttgcttctatacatccatatataacagcatcttgatctttttttctttcaagcaatacaaaatctggaaaacctgaaaggccataaaattttgctgaaatttcacttctttttcttgatgacacatctcgtatagataatttttgcttatttttagattctctaattacacttgcaattattgaatagagttcaatttccacacaagcattttgagcaaaagctaactcaatttcttctttaaaatcatcaaaatctcttgctattgacattatatcaccatcccatcaaatcccgaatttacgacaatatttctaatacagattttaccgtattttttagattcagtccatcttttaatcccagtcggtagaaaaactcttctgtatctgctccactactgaaaattgcgttacagtattccgtaatcacttcttcctgttctggggataacgtttccagtaattcctggtatttcttatctatctcacttaccggctctttatcctgatttaacttccattccgaatatgctttccccatatgctctgtaattgtcagattcacaaattcctgcacttcctctggtatggtactcgtagattcctgtttatctttctttttatcatttgatttttcaagtgtcgtgtcatcaatataacgaatgatttctcgaatatttgacttcatcgactgcagatatcctttcatcagcacagcaacttttctagcatccgatttttcgttttctttttccagcatataaaactcttccagttctttcaggatatccatccctgctttcatctgaaattccacctcaagcaaatcatccatcactttatataattcttccattgtttatttctgcctttccatatagtatcactatattttccacaatcatccaaaaataaagtcctgtaatccacattttacaacttcaatcactgcaacgatccccataccaatatgtggaaagagtacaaacactactgtcgtaatgatcgctgatttcattgtccagtccgtgctgattccaaatccaatactcaagacttctgtcacaacagagattccggctatcagatagcagaatcctgcagataatccaaccaggaataccaacacaatatttaccgctgcaagtaccagccaaacaggagctgcaataattcgaaatggcagttttatcataaatctcaacataattcttcctcctactttgtgcccagtgggcacaaggttattttaccatatctaccggatatgactatctctttttaaacttcgtgcccagtgggcacaaagttcttacccgtccggaatatccttgccccagtacatatcatgtcgaacttcagcatcataaaactgattgatcgttgctggggcattatacaacaccgtcaacatatactgccggatattcttcactttgcttgtactcctgtcaagactgaaaaacacatactggatgtgttcatacccgactttgagcaaacggctcttgaccacttgtgtaggcacagcttccccattgatctgttgatatggctttgtcgaacatattgcatccagcatcagctctaccagctcttctacttgtccagttccatagctctgacaaagaatctcatattcgatattgtcatgaattaactgtcgatactcatttctctcctgtatcctatctttccctttctcttgttcagatagatattgataagattcattctcactaaattcagtataattatattcagtattattacagtttgtttttgaaacttcttgaagtttgttttctaaacttcttgaagtttgtttttcaaactccttgaagtttgtttttgaaacttcttgaagtttatttttcaaacttcctgaagtttgtttttcaaacttctgtgtatttacgggcttttccggctctttttccgcatattcttctatttctgtctctgtattttcttttctctctgctacattttctagtgttttttctgaatcaaagattgctggctcatctggatattctgtcaggctaaaatttttcacgtaaataacatttgtttttccaagtccgatccgtctcttctcaatcaatccaatccctttttcctgatccagctctttcagacaattcaccgccttattcctgccacagttaagcatttccataatctcttccaccgaaaagaaaatatatgccctgtcctcttcgtcaaaccaccggttcttgatggacagtgacatccggtctaacatcagtccgtacagcacctttgcttcacaggagagatttttaaaatattcacttgtaaacagcagtttgggaatacgataaaaactgtacatatcgcattccattccttgaaaatagtggaatgttgctcttatactcatgacccatccctcccttcgtacttatcaatgattctgattgctccattcctccaaaagctgacatataacagtccgtatcttctgttcatcatactctggaggaaaatacttcttaatttcatcctgttttaatgttaccgttgttttctttttacgctctcctataaccaggagccgcacaatctcttttgtcagcgttttttcttctcgatgttgccttatttttttcgcctgttccagacttggatatttcccggtactctcatgcacttcctccaccatctcctgttctggaaccgcaagataggaaagctctacacctacctgcaatccaatcacatcacggtctactgcgtttaataggtcattcatcagatacgtgagccgaatatagcgatacacctgccttgcactgtcatttccgttctttccaatatctttcgcactgatacctcctgatgttccctgatgattcattgcttccatcttcatacggtatgcaaatgccttttcacttgggagtatattaggtctctgcagattgctgtctaccattgcccgaacagctgtatcctgatccatatttctgataataaccggaacctctttaagaccggcaagttgtgccgcatgtctccttctgtgaccggcgatgatttcatattcaccatcacccagcggtctgaccagtaatgctgtaagaattccctcttctttcacactttccaccagttccgccattgcctcatcatcatttacttgaaacggatggttctcgaaagaatgtaaatgctcaagtgaaacctgctggatatcgttcgtttcttctcctccgccaagtaattcatcataagatgtcagttttatcttcgatgcacttctacctttcatccaaaagcacctcctgtgtcatctgccaatatgcagccgctacttttccttttggatcatgctcaaatatgctgattccttccgcactgatctcagctgctcgtactgaaaatggaatactccgtggaaaaatcttgatctggtttccatatgtatcaaaaatcagatcagatatatctcttgcatagttcgttctattatccaccattgtgatcaatataccgccgattttcagttgtttgttaagctgtcttcgcacctttcctatcgtccgtatcagctgttccagaccctttacaggaagataagccgcctggacaggtataataaccgcatcgacactggcaagtgcattgatcgtcagcattccaagtgatggcatacagtcaatcaatatatagttgtattcttctctcattctttctatatattgttttaagacaagttccctactcataatatttacaagtgaaacttccattccagagagttcgatgtttgccggaatcaaatcaattccttcctggtgatgtaaaattcccagtgtattttcaaatggttcatcttctacaatctttgtcagaatagtagccagtgtgattggtaattcatctgggttatgatacccaagacttgctgtcatacttccctgcggatcattgtcaatcacaagcactttcttccctgcttttgcaagtccgactgccagattcacgcaacttgttgtcttgccaaccccgcctttttgtgaacacaatgccagcactttacaatccttcattactttctcttccatcctttttatcctcccataaataacttgaacctttcagcatccataatgctgcttccaaaaatgcaagataccgttctgtcatactatcaagagccggttctgaaataactggtttttcagacttcaaatcttttgccacatcctccaaaaccaaactcatttccttcatttctgaccggataatttcaattgtttctttctttccaacaacacatacatgattgtaaatgcatgatcggacgatataatcctgttttttcattccgctcactttcactcgttcttcaatcgttgctttttcataagaattcacccgaaaagaaatggtcgttgtgttgtgttttccatgtctgtcaccagccatcgcttattcctcctcttcctcatgtttcttatccagcaaacctgctaatttactctgcgtagacggatacagatgcgaatatgtattcaacgttgtttccaccttttcatgtccaaggcgttctgcaatctccaatggagccacccccatatcaaccagcatactggcatgggaatggcgaagatcatgaagtcgtatccgctttacaccagaccgctcaattccggtagccatacaatgttccatatgcgatttggtaaaccgaaaaagtctttcctttttcataattccatacaaatgactgcaatactcccggaattcctctgcaagaaagtccggcattgtaatcacacggatactctttggagttttcggctgcgtgatcatatcctttcctttcaatctctgataagatttattgattgatatggtcttctcttcaagattgatgtcattataagtaagggcaagcaattcaccgatacgcattccggtccagtacagcagaagaaatgccattcttgtttctggcttatcacttactgtctccagaaacgcattgaactcttcctgcatccagaaatccttcggttctcctttgctcttgccgatcgctcctgccttcctgcagggattatcttgcaggttataataccgcatggcataattgaaaattgcagtcagctggcagttcactgttttcagataagtaggagaatatccttttccattcttatctttatacgtcagcaactcattctgccatgcacggacgtctgccaccgtaatttcactgagaatcttcttttcaaaataaggcttgattttcaggtcaataatataccgcttcgtatacatagtgttttctctgagacggacatccatatctttgtaataaatctccaaaaaatttccaaattcaatatccacaccctggctctgctgttgtaggaaatctctttcccattccctagcttcacctttggtcctgaatcctcttttctgttttcttttccgatttccctgccagtctttgtaatagacctgtactttccagttttttccttctttgtaaacccccattactaatcctcgactttcatgccataaatcttttctgccaggaatttcgtagagatttttccagctactacaatatatccttttgccttcaattctttgttgtattctcgcatcagactatatgcataagtctttgaaactccaagaattgcacacacatcatccacatccatatacattttttcctgcaccatactcataccgctttatcctccttcaaatactgctcaacatgttccagaccatagatcttgtcctctacataacgggttggtacccgaccgagaatcacataaaagttcttgcttgccagatcggcattcattctttccaccacccggtaagcaaacgaaactgataatccaaagagttctgcaatgtcttccactgataaatacatttttctcttacgcatgaaaccattcctttccctcttcctgtggaatctcacaagtatcttccactccgtagaagcgcttcacaaaatactttgtcggaacttttcctctaagcgtcagatatccctgttcttccagttccttgttcagatttccgatgatctcataagccgatgtttgttttacttccagaagttcacatatatcggctgcctttaaaaataatttgttctgcataatcagtacctcctgtgttttgaatatttatctcttcatatactctgtactggcagatgcaaaatcggacatcatttttcgaaatttatcaaattttcttgttttttaattctccatcagtgtgattactgtgtcatggagtttaagctcatcgaaagtaaagaacctttctgtggtatctgttttctaaatgcaggcaacaaaaaaacagtctgccttgacgaaaatcacttcaatcaaaacaaactgttcttcatatttactctaattttattttatgagaataactgatttcacgaaatttgcaggtgaatctggaatataaacaagagaaaaaaataatttttaaactccatttgcactccatttggtcttttcgacaccccgcaaagcctttatttatgggcttttccgcgatttttcaagctactcaaattcaatcgttgctggtggttttccagtgcagtcatacatgacacgattgatgtgttttacttcatttacaattctgcttgttgtttttccgattacatcccacggaatttctgcgctttctgctgtcatgaaatcagtcgttgttaccgcacgcagtgcaattgcgtaatcataagttctttcatcacccataacacctacagaacgcatattggtaagcgctgcaaaatactgtccgatttctttatctaacccggcatttgcgatttcttcacgccagattgcatctgcatcctgtaccattttcactttctcagcggtaacttcaccgataatacgaattccaagacccggacctgggaatggctggcggaatacaagatattccggaataccaagttccagacctgctttacgaacttcatctttgaataagtcacgaagtggttcaataatttccttgaaatctacatattccggaagaccacctacattgtgatgagatttaataacagtagattcgccacctacaccactttctactacatccggataaattgttccttgtactaagaaatcaacagttccgattttctttgcttcttcttcaaatacacgaataaattcttcaccgatgattttacgttttttctctggttcttctacaccttttaatttaccatagaaacgttcctgagcattgacacggataaagtttaagttgtaaggtcctgtcggtccaaatacagcttctacttcatctccttcatttttacgaagcagaccatgatctacaaatacacaagttaactgatttccaactgcttttgataacataactgctgctacagaagagtccacaccgccagacagtgcgcaaagtacttttccatcgcctactttttcacggatagctttgatactttcttctacgaaagaatccatcttccagtcaccagaacattcacatacattgtatacaaagttagaaagcattgtctttccttcttttgtatggagtacttccggatggaactgtacggcatacaggttcttctctgtattttgaacagctgctaccggacagtcatcagtatgtgcaataatttcaaatcctggtgcagcttctgcaatatagtcattgtgactcatccagcagattgttttctcggatacattttcaaagagttttgttgactggttaaccgtaacttcgattttaccatattctcttacaggcgctgtctctactttcccgcctaataagtgcatcatcagctgcgcaccatagcagattccgagtacaggaattcccaattcaaaaatttcttttgtataagttggtgaatcctctaaatatacgctgtttggtcctccggtaaaaataattcccttcggctgcatttctttaattttttcgatatctgttttgtaagaaaaaatttcacaatatacgttgcattcacgcacacgtcttgcaattaactggttgtactgaccaccaaaatcaagtacaattacggtttctctcttcaacaaactctcctcctgttcttttttgaatctttttaatcagctttttcatgttttagaagtatgcattttaatttttgcattgtctaagtgctcatattataagccatctaactggattttacaagttctttcaaaaaaacacctttaatttacaatatccctaagcccgctttgcttttacatcggattcacatgcaccatacaatgttttacaagaggaaaatttttctcaactgcatcatgtactctctgcgctatttcatgcgcattttccagagaaagtgttttatctgctgcaatttcgatatccacataaatttttgcaccaaacaatctggtctggagcaaatcaatattttccactccggtctgacttgcaatcacttctctcattttctgaattgtcttttcatcacaagatttatccaccattttatccacggcatctttgaaaatatcgtaggctgctttcccaataaaaatacaaatcacaacacttgcaatcgggtctaaaatcggatatcccattcgagcacctaaaataccgataaatgcaccaacagaagataatgcatcggagcggtgatgccatgcatctgccataagtgctccagaattaattttcctcgcagctcctcttgtgtaccagtacatccattcttttgttgcaattgataccactgctgcaacaagcgcaaccaaaccaggagctttatttccttccactccttttataatctgttctaaaccattgattcctattccaattcctgttgcaaataaaatcactgccaaaataattgctgccacacattccattctgtcatgaccatactgatgatctttgtcagatttttttcttgaaatgttgattccaatcactgccacaactgtactaaatacatctgaagcagaatgcactgcatcagaaatcatagcaccggaatggcccaaaataccagctaataacttcagcaatgataaaacaagatttcctgcaattgtaactccggatactctcatcactatcttttttgatttttcatctgaaagctgttctaactgttctgcatccatttttatatcctccttcttctgtaaagcggacatttgcaatccacttcgctacttactcataaacgcagtcacttcgcaacctgtcacagtgggattagtgcagagtattttttgtttcataggatgctcctatgaaataaagaaaaaagcacctgtggaacaataagtaaactactgtcccacagatgcttttcattttcacctgctgtcacttttgtgacccggcacgtaaagatttttctctctttcctgcctgtttcgttttacgtcgccctcggcgtttttaagattttatgttattctatgacacgaaatacctgttagtcaatagaaacattcgttttatgtaacctcaaaaattcaggcatttatgacgcaaagtcagctgcaaaatcgtccccaaactcgaagattgagatagcactcacatcatttttatacaagagaagcatgtttccactttccgcccaggtaacggatagtaaaacagatagaccgaaacagccagtcaatcgtcattgcaacccatattccaaatactccccattttaaatacgagcctaaaatataactgaatccaattctaaacgtccacatggagacaatcgccagtatcatcgtatattttacatcggctgccgcacgcaaagtatttgcaagtgagaaagacaatggccagatagttacaacacagcagctatgataaatcaaaattcttcttgcatattcactggcttccgctgataatccataaacttttataatgaatggaagcagaagcaccaccaaaatattcattaaaatcaaacagatgtacgtcagcttcattaattttttcgtataatattttacctgttcaaaatctcccgctccaacacactgcgccgataccgtgagcattgcaaatccaattgacattccaggcagtaccgcaaacattgcaatattattagataccgcatttgctgcaatcgaagcagttccaaagctcgtcaccaggctgagtaccagaatttttccaagctgaaacatactgttttccagaccgttcgggattccaatatacaaaatctttttcaaaagattccagtctgtatgaaatgaaaatggatgaaagatatgaatctgacgactctgattatttaacagaaccaatataatcgctgccgctacacatcttgatactaaagttggaatagctactccctcaattcctctgtggcatccataaattaaaactgcatttcctccaagattaactgcattcataatcaatgaagtaatcatggcaatggttgaatttcccatggaacgaaaaatagctgcacctgcgttatatactgcaatcattgggattgacgcaaacacaattaaaaggtaaatattacagttatacataacatctgcgtcgattttaccaaaaataccatgcaggattacatttctaccaagatatcccaatgccataaccacaaccgatgctttcaccgtaaataacaacagctgattcgttgccttacatgcctcagcctctttttgttttccaataaactgaccggcaattactgcgccacccgtagctaatgccgtaaaaatattaataattaaaaccattactgtatcaattaacgaaactcccgatacggctgcttctcctacacttgctaccataatagaatctgccagtcctacaaatgcctgcagaaactggtcgataatcaatggtacaatcagttttttcaaatcctcatttgaaaaaaatcgcttcattttttcactcacactccatactattttgtacattttcagatgagtctattatactcttgcgatgagaaaaataaaagagtcggaacgttccagactcttttattctttataaacactgcaaaatcaaccatacattttcaaaatttcgcatctttaaatcctgcttttttatccaaaaataaaggtttccttgatattcccatctgtattcatcatcgtatccatctattgttcccacctgaaataaaagcatccaatccttacctttttcccaaatttcctctctttcctgctccggcacatcctgccagcctctgcctagataatatccccttgtaactccttcacattcttcttccattcgaccctgtaagacatccggattccctaacaattttatccttctgtatgcccattcgtaataatattccattccctcctcaaatatcggaactccacaggattgcagacattcatcatagtcgtctaaatcatcacacacaattccctctgttttttttaatttttctaaatccggaagtagctgttcatataccggcagactttcttcgttttttatccttacaattttcatttctgaaatgattgcatctttctctaattctgccggaaaatccattgcttcaagttcattttcatccggaaaataataaaccttcgcacaacctttatttgctggatcatatccataatccatcgaacgcatttcataaaagaaactaagaattccttgtttcggcaataattcttctttatcataaggtgcaacatcctttaaattaatctgtataataaatgataagggtctttctttcctgatatcttcaaaatctttcccttcataaactggccattcaaaatcttttggaacatccggctttcctccgattttagacgctctttttgcagcaccactttttagagtgtaattgattactatttctgttttcttattttgttttatcaactcacaaatcctatttttttctgcctgattcatcttatttcccccaaccttttatttttatgctcttatcttaccattctttcccttctctgcaaagaactatctttttttcttccaaaacaaaaaaagaaagccagattttctgactttcttaatttttacaatataatcagcagcagctgtcttactctctttctactgcttattcattactgattcattatttattatttcattctatgtttcattctttttccaacaatcactgctccaattcccacacagccacttattccaaacagagcaagccaaaattctattctgctgttatctcccgtctgtgcatttttagcagttgtactcttattcgcattacttgttgctgttttatttgcattatttgttgctgctttatttgctgtcttgtttgagttgtttgctgttgccttatttgtattatccgtcgttgtcttggtagatgaggtctgttttttctctagtgaagcaatggcatcttctattgcttttgccatcttatcgacttcttcctgctcggtgatattttttcctcgaactactgcttttactgctttttctactccagtaaagtctttatagtctgtttttttcagtgaatttgcttttttaactgcttcatctacttttgtataatctgcatctttatattccagagcgctaatggcatcttctattgcttttgccatcttatcgacttcttcctgctctgtaatatttttgcctcgaacaaccgcctgaactgctttttctactccgctaaaatctttataattttcttttttcagcgcatttgccttttcaattgcttcatctgcttttgtataatctgcatctttataagtcaatgtcagtgtctgggtatgcgtagcaatatctgcagtaaccgtaatttcaccgctaaaaggattacaattatccgcagttatttcaaccggatagattcctgcttctaattcagccaaacctgaagacacttcttctccatttactttaagaaccacatttgtcaattctgccggcactacagcaaaggaaacttcatacttaggttttggcagaaccggagtcttttcagaaacataattataatttccgccacctgccacaatttctttataaaatgcttctgttctcatagaatcaaatggtttcgctgtacctgctgctgcattttttccgcacgccaaaacattttctttctctgtataataattattcgtgaaaatacctgtacctgaaactgctccactaatgccaccaaaccggctatatggaacagtcgttaccgtatactgtgacaaatcaatatttccagcgaaataacagtggctgactgtcgtttcatttcccactgttcctacaattcctccaacatccgtaatcccttttccgagcggggttaatgttcctgttgaatagcagtttaaaatcttagaagttccactagtctgtccgacaattccaccaccatgacttgctgccagtatcatatttccagtatttacacaataacttacttctgtatctccagtagcatatcctaaaattccacctgcataaatacttcccatgtcacctgttatcgtaatatttcctttattttcgcagtaatttatctttgtattttctgcgtatccacacattccgataaatccataaatatatttcccattattctgaaatccaacttctgacacacagtcaaaaatagaagcattctctgcgtatcctgcaattgttccaaaaaaggtatattcactgtcgtctgctgtaacattaacgtttccttttactgtcagacttgaaatttccgccttttcaacgtatccaaaaaaacctccaactgctccttttccataactggaagaaaaatccagatttgaaatcacatgtccattcccataaaatttaccactgaaacagtgttcaatatctccggaagcattagcttgtcctatcggtgtccactccacacccgataaatctaaatctgcatcaagcactacgactgcatctgttttttcatcataatcacctgcattgactgcttttgcaaatttcagcaattcgtccacagaagtgattactgttttactgccctgttcttctccttctgcccataccgactctggcagtaataacaaacacattgccagcaccagaaacagtcctgtaatctttcttttcatacgcacctccgcttttccatttgtcagcttattccactctatctgaccaaatcatattgtttataatttatatcatacctttttttctgacaaatagcaatctattcgaagatgttttgagatttttcattccacactgtgtatcccgggagtttggcagtcgagtaattaaatgttcgtaaaaaaagagaggatgtgctctcctctctcttcccaatttttttatttttcctacatttctccaattttctctttccatatttcaaccagtctttccaccgaatatgctgcatttgccggactggttgatggaagtacttccgcttcaatcccaagctctttctgctgatattttcgaaaatacgttccggaagtttttccattacagaagattcgttttacattactatcttttacaatcgcttttaaatccgtcggaactacatttttaatgctgctgtcactggacccaataatatcacaactgtaaatagtatcccaaagcgctacatgatgccgatataacattgctttcttttcttcgatattctttggcaccggttcatttaacactgctgcgattactttccaaaatcgattctgcggatgcccataaaaaaacatctgctctctcgattttacagacgggagacttcctagtatcaaaatttctgattctttattataaagtgccggaaatggatgtgttacatgagtatattcctttgttactgctgcttttttgaccatctttctgtctcctcttctatttctgtccttctttttcatgcattaaaagatatttctctctcgttgcaattccaccacgaatatgccgttccgatttattcctgtccaatacctgacgtacttctaatcccaaagtaggattaatctgaatcagacgctcggtacagtctttatgtaccgtacttttgctgattccaaatttctttgcggcctgacgcacagttcctttgttttcaataatatagcatgcaatttccactgcccgttcttcgatataatctttcaacggataagcctccgaagacgctgtttttacagtgtatgccctggatttacagggtattctccaaactctattgtattattttcctattttccctgttccggattagcacccgtttttccattttcctgttccgtctgcgtatccagcatcattttaataatttctttatctgtctgatgcattccgacttttccgatgtatcccacacagctgattgtttcttctgtatcctctttaacaattccggtatatgctttatacgccttatgattcattgcaagataatgtgccatcattcccgcgtctatactggatgcaatttttgctgcacaggagatctttgcaccatcacagataattcccggaatatttgccaatgtattgtcaatcgttgctttaatctgtgcaacacttcctccacataaataagtgattgcggcagccgatgcacaagaagcagaaaccgcaccacaaaatgcagacagttttccaataaacattttttggtacgtggtcaaaagacctgaaaaaaccagtgcccgatacaattcatcatttctgtaatttttttctcttgcatacacgattacgggaacagaggatgcaattccctgatttccacttcctgaattaataataaccggcatatcacagccactcatccttgcctctgaagcggctgctgcataggctttcatacgagtcactactccgtctgcataactctcacgcagcactcttccaattccaagaccataatctccggaaatcccctcataagcaatatccatattatatcgaatctgtcgttcaatcatcggacgtactaaattcaatggcacttcatctgcaaactgtttgatattctccaaagtaagcacggaacggtctgtcagaccacctccggttgcttcgttctcatcaccgataaaaatcgtttctccatttttttctatttttgcaatattcgtatgtgaataacggatttcaaccattgctgaatctgctcctgctgacacttcaaccataaaatgcaatggaatatccgaatccagaaattcaacttcacaacgtttttgttccagcaattttttcgtctgcgctctctgttcctccgttaccttttctaaaacttccattttattttctgagtgacctgcaatagctcctaaaatacaggctgtttcgattcctgtcattcctcctgaatttggaatcgttacacaacgcacatttttaatcatatttcccgaacattttgccacaatatattccggttcacatcctaatatttctcttgcttttgcagaagcataagccagtgcaattggctctgtacatcccatcgccggtactaactcttcctgcagaatcgctaaatatttttcctgtaagttactgttcattgacgatttccccatctttctacatttttttctattgtaacatgataagataccaaggtcaaaagacatgatggggataaaccaccttttgactttggtatcttaagtaaagcggatattcgcctgactattatcttcttttttattctccgctccgtatccgttctacaacacttatacggcacattttttcacatgccagatacggtacgaaaagcacaatcaaaagcaaaaacggtatacagattagaattggaagtacagtaaatttccatgtaaaaaagaaaaatccggatgtataactttttattaaagtcatacttaaaatacttcccgcaagaactgctactatacttgtaaaaagcgcataatatccgccttcccacatcaacatctctcttaattgttttctggtcattcccactgattcgagcatggcaaattcctgtttccttgataaaattccggtcaaaatcgtatttacaaaatttaaaattccaatcaatgccaacacaaaacttagaaatccaccaacgattacaatcatattttgaagcgtcgcaaattctgcctccatcgttgattttgaagtataagttaaatcatcgttgatattcgtacaataattttccagccagctctctatctgtttttcatctttttttgatacattaaataatgttttcatcggctgtctgccttcaaagtaatttaaaaattctgaagagggaagaatataatttatctcaagtgaaaaatacatctgaaattctgccggataaggcatcgacacaagtgccatcacctcatactctttcgtaaacccattttctccagtcaacgtgattttgtctccaacatcgtaaatcggtttctcgccatcatccgattcgaattgattgaccacaatataatttccactcttgaatttctcccaatctaattcgccctgctcacattttaacttttcaaataccagctggtccaaaccatacatttttgctgtgatgctcccacgctctttatcggcgtctatttcctgtttcatgtcctcttcaccaatcgactgaatcatgtaagcaaaatttttcttccaatccttccagattctctcttccaatcgttctttttcccagtctgataacttctgttcccattcgctgtaatagacatttccgctttctttgattccatcctgttcccgtaattccgtcaaaaaatcactggtgactccatcttccgttctttctgaaagtgccggattatccgttgtcgcatccgttaccatataatcgcttacactcctgtttgatacatatttatccatatcaaatccctttagcaacgtacaaaccgtattaagcagaatcagacttaacgataaggaaaatacaaccaatactgctttttttcgatttcttttgatatttgccagcccaaaagcatgcatggtaagcttatgagttcttctctttttcccttttacctttgcatttacagagctttcggtcagcttcacagcttcgattggggaaatctttgctacgatacggcacggcttaatacagctgatttgaaccgtcaaaaaagaaaagactgccgaaccgataaaaatccatggatgaagcaccacatttgttccttctgtatcccccatacttaaattggcacagataatcggaagtaatcctgcacccacaaccgcacctaaaataagtccaatcggaattcctgcaagagaaagcagatttgcctgttttcttactatttttccaagctgtttttttgtcgttccaattgtctttaaaagtccataaaaccgaatgtctccaaacacattaatgtaaaaaatattataaataatcagatagccggaaaccagaataatgccaagcattacaacaataagtacaactgtttcagcgtctgccttcactccaagatatgcccagttcactcccgttgatttttcttcgaaaccaatccgcttatttaattcttccagctgttttttaagattaaacgaggtcttgaagttaaaatctaccatataacttcctgctatatctcctccatattgatagctctctgcagttggtgcaagctgattgaccagttttttcgaaacacacattacctgtgacatcgaaacacgatctcccttataccatccgcacaggataaattctttggaatatttctttcctcttacactaaaatcaaccgaaaatttctcaccgattttgcacggaacgcccaatgcctttaaggtcaaatcgcttgccacacattcattttctttcttcggcatgtgcccttcttccggataacaaaaactccattttgcctccaactcctcataataagccatttctgtgcgtactttaatcaaaggtttattctctgcatcagcaagtgcaattcgataagaaaccgattttaagcccttgtcttttgccactttttcatattctgattttgttaagtatttatatcctgcatgagcactgcctccgacctgccgcattgtagattcctgatttttttcaatcagacttcctccaatcgtaaacagcgcagtaaataaaacagaggttaatgcaatggctaaaattgcaattaaatttcgcttttttcttgcctttaaagacttcaatgcaatttgattgatcatctttttatttttcacgttcgacacagtctgcaccctctttctgatttggatttttgtccattatctgcaaggtctgttttccggacacaatttttccatcttcaatccgaatgatgcgatccgccatctgggcaatttcttcattgtgtgtaatcatcacaatcgtctgatgaaaccgctcactggtcactctcaaaagtccaagcacatcctgactggtcgctgaatcaagatttccggtcggctcatccgccaaaagaattgccggtttcgccgccagcgcccttgcaattgcaaccctttgctgttgtcctcccgaaagctgacttggaaggctttctaatttcttatttaatcccaaaagcccgatgacttctttaatataagctgtgtctactttgtctccatcaagctcaaccggaagtaccacattttcgtacacattcaagaccggaactaaattatagctttgaaatacaaaaccaatctttcttcttctgaaaatacagagtgcatctttttttaactgataaatttcttttccatctacaaatacctttccagaggttggctcatccaagccgccaaacagatgcaacagggtcgattttccagaacctgacgaaccgacaatcgcaacaaattctcctttttctacagataaatccacaccgtctaaggcttttactgtattttcatgatttccataatatttctttaagttctcgcattttaatacttccatctctcatcttcctttctgtttttcctaatttcttatctaatctcttttgttaatttcagtataacaaagaactctttcgagattctttcggaaatctaacagttttgaaagatttaagactcctgtcctaccttggaaggtaacataaaaatgtacttccttttcccacttctgaatttacttttataaatcctccctctttttgcaaaatctcccgcacaagatacagtccgattccaacgccttcttcctgctgtacttcttttgcccgataaaaccgcccaaatatctttggaatttcttcttctgaaatgccacgtcctctatcacttaccgcaatcacgcaccacatttcatacagcttggttgaaatcaggacttcacttcctgtcggactgtacttcaccgcattgtcgagcaaattataaagtgcttcttccgtccattttctatcaaaaacagcctctgcctcaaagtccatttctatctttatctgaatttcttttttctctgccttcttccgaatttcttctactgcactttcaagtagcggttttacctgacttttaaccggtaccacctctaaaatatttgtttctaatctggaaagtttcgttaacgcctgaattaaaaattccagtttctgtgcctgtgcctgaatctgtcccagcagttccgcttccataccgtcttcttccaactgttccgaaagcagttcactgtatagttttatgtttgccattggagttttggtctgatgagaaatatctgaaatcagccctttgatattagccttttctgtctctaaattctgctttgccattgcagaatcctgtaaaaaccgtttccactttgactctactttggaaagttcactttcatcatatttagactcttcaaattctccacggattccctcatcaagcatttgatttaaccgttcccagtttcttcttccccaaatcacttttttatcactcttctttcctccagatatagccctgaccgtatacggtctgtatatattttgtctcgccttctattttctttctcagccggttgattgtcacagacaacgcattttcatccacaaactcagcgccatcctgccacagacgttccatcaaaatttctcttgtcaaaatccgtccctgatttttcaaaaaaatctgaagcagtctctgttcatttctgcttaaacttaattcttcttctcctttaaaaaaacagagccgttcaaaatcaaatttcaaattctctatcacataataatttggcaaaattgactttatactctgattctcacgctgttcccgaatccggcgtttctgcacttcaatccttgcacgaagcaccgccagactaaatggtttggtaatataatcatctgcaccgagtgaaagccctgtcacctggtcgatttccaaatcattggcagttaaaagaatcaccggaactttcgatgattcttttacgaatgccaaaaaatcatatccgcttccatccggaagattcacatcaagaatgacaaggtctgcgttctcactttcccacatttcttctgccgtttttaaatcatgacagactgtgatttcgttttctttttcagaaagtgccaattcaattccctttgcaagtgccttgtcatcttccactatcataagtttcattttcttttttcctttttatttttcttgtaaaactgcggtaaagcggacattcgcaatccgcttcgctacttgctcatgaacgcagtcgctttgcgatctgtcagtgggagctttcaactcccactgacagaagcatccccctcacccgccgcttattgctctgcgcacttgaagcggtggaatgcttatctgcgttcaaaaagcagacttatgatttttccacaaatctgcttttcgattaccgtttatttttttcctgtgcttctatcatcagccagttctaattcaaactcctctccaaaaaactcctcatattcttctttgtattttttccatctctcctttcgttctaacgttatcttcttaatctcctccggggtgagacgattttcacgcatcggttcaccataaccgttcggataaggttcactatccggtaaactgtctgtataagcgctttctaaatcttcgccttctgcatctaaaatttcttcccaatcaattcccataacgactgtctccttttcgtaaaatcctccgtcttaattttgtttttatattctacggaaatatcacttttgtcaatagattttccaaatccaatggaagaatttatctctctttttcttgtgatcagtgtttcaaagcttccacagaatacaaaactgatttttgaggtatcaaactccattgccacctttcctttatcttccggaaagaatactttgtttccctcaatcatctttaacagctcattcttcattgcagcactgtagttatttccgcctgagccgtactttggttcacacagtttatcgaactcgtcgatgacgataatggcactttccgcctgttcccgtgacatatttgcaaaaatgtcacgaagtttaaacgcaccgctccagccttccattgtaagcattgtaccatcgacaatttggatattcggatataactggcttagtaccctccagatttcggtttttccgcatcctgtcggtccggcaaataatacattgcgcttctttccatgccagaattttgcgacgtcttcaatatcctttaacatgctgttatagacttcatccgtatagttatcataaagtcctgcttttgcatctttggtaaattgaactgccggattttctttttggatgattccacaacctctgatgagctcttctaaaaaatatttaacattgcggatatagctttcttctttcattctaactgacctcctgtgcttttttctgtattctcaaaattttctgtttctttttgttcttcttgatttcattataagcacaagtgccaaaattctcgtaaattttacgacaaaaagagcgctgttttaaacaaacaacgccctcaagatttttcattttttcgcaaaaccggtacgacaactccaccaactaaccacaacagaagcgccagagataataatcctgaaactaccattccaattaaccctaccattttcagattttctgtaaagctatatttgtctcctgctcacacagtgcaatcaatttcaaatcttcttccaatactccattcaattgcattctgacttcatccgaaaattcactccagcatttattaatttcttccgcataatacagattttcatgcaaaataatcaaaggagaatacccaaacagtgtatacaaagaatttaaaatcacagcatccggctctgcttccattcgttccagacgctggtaacgtttgatattaatatccagccgttccgccattttcatttgtgtcaaatcttctatttttcggatacttctccagatatttctatgttgttctttttcttcagcaagccggatatacttccacactctctgatttgcctctttccagttttctccgtgcatcagcataattccctgtctggtcagccagaataatgccttcattaattctatttttccatccgaagtcctgcaccgtttcatacagtcctccacgattcctgttttataatgcacaccggtaaccagataattgacatctcctccagccttttcaaacttcttcaaactgctgtatgaaatatattttgttccactttccagtttactgtagtggctttgattcacaccaaattctctgctcatttctgcctgacttttgccaagctgctggcggtaagacaccagtctttgagatatactattgtgctccaacgttataaacattctccaataatttccaatttttactatattgtagaatgtttttcttgtcctcctgtatacccatttgtgaatatttgtcgaattttggcaataaaaatgggaaaaggcaaaacccttttcccaaaaaatatttattttactgcttcttttaactttttaattaattcctgcacttcttccgtactgattccggcaaaacttctcaaagcacgaagtggagaattttccatcatcttaatcatcatctcttgagaaattgcttcgcttgccgcactgccttcttctccaccaccgatgtttgccatcatctggtctactaaatctttcatgacttcttttgctttttcattttccatcaattcagaaatggtcgtgtttgtatgaatttccatcggaatcttcattgtagattcaagttctactgttttggttaatcgaatgtctctggaagaacttccgattaagatttcataagttccgcttcccgcataccagtcatttacttttgtattataccatgcaaaacttcgtttattaagttccattgtcacagtcttttcttcctgtggctgtaattctactttcacaaagtttttcagttcatttaccggacgcatgactgcatttgttttatcagaaacatagagctgtaccacttcttttcctgccatttttccggtattttttacctttacactaacctgaagggtttccgtatctttgattttttcttttgaaagctgtaaatcactgtattcaaatgtggtgtaacttaaaccatatccaaatggatatcgaaccggcatttttttcatatcataatagcggtatccgacaaatacgccttctttatattccactttttgtccatctcctgggaaatttaagtaagatggattgtcttctaaatgatatggaatggtttctgccagttttccggatggattcactttaccaaataagatatctgcttctgctgcgccaactgcctgtccacaaagatacgcttctaagattgcacttacgtcatctgcccacggcatttccaccggtgaaccgttatgcagtacaactacaacacttttctgtacttttaagatttcctgaatcagataattctgacagtctggcattcccatatgttctctgtcatatccttcggattcaaaggcatccggaagtcctgcaaaaataactgcaacatctgcattttttgcagtttccacagcttcttttaacatcgcttcgtcaattttatcttcttttacatcatacccctgtgcataagcaacttccgtatacgcttttaccgcatccagtgcactttctactttaaaagaattaatatgggaacttccgccaccctggaatcttggtttttctgcaaatttaccaataaaagcaatcttctgttcgccggctttaagtggcaggattccgtcatttttaagcagaaccatcgattcttccgcaattttctttgcgatttgatggtccgcttctaaatcaaatctgccttcctgacgattatctgtatatttaaaaataatatttaaaatacgttctactgcggtatcaagcacactttcttctaatgttccatctttgaccgctgatacgatttctgcatcggtatatccaccgcttcctggcatttccaaatccagaccggcttttaatcctttcacacgttcattaactgcaccccagtcagacatgacataaccttcaaatccccactcatctcttaaaatttctgtgagcagtttatgattttcggatgaaaattcgccattaattttattataagagcacatcacggtgtccggtttgccttctttaatcgcagtttcaaatgcccctaaatagatttcacgaaatgtacgctcatcaatttccgaagaacaggacattcttctatattcctgattgtttgctgcgaaatgcttaatcgaagtaccgatgtttttagactgtactcctttgatgtgtgcccctgccatctcggatgcaagatacgggtcttccgagaaatattcaaaatttcttccacacagcggagaacgtttgatattaactgccggacctaaaataacagaaaggttctgtgcctgacactcatcacctaaggtctctcccaatttgtataataagtctcggtcaaatgagcaggctgtcgcacacgcagttggaaagcacactgctttaatactatcatttgctccaaggtggtctgcctcctgatcctgttttcttaacccgtgaggaccgtcacttaccatcacactcgggattccaagacgctctacactctttaaatgccagaaatcttctccggaacacattccggctttttcttctaacgtcatctgttttacaattgctttaatatcacgcttcattaaaaaataattcccctttctacgttggttttctactttaaactttatcacatctgaaccgttctgaatatcaaaatttctattttttttatacaattatcgtatctttatctatccaatatgtatagaaaaagaagtcacggcaattgccatggcttctttttctcttttcgcttttacttattcttccatatttgcgtaagcacgctctctgtctttttctttaaacttatgagcatcctcaagcatcatatcttttactttcatcagacgaatctgggtacttctctcattttcatccaatttcatagtaatatatttaatattattctgtgcttccggaataattacatgttccagagcgtttactctacgacgggtcttttcgatttccgcagccatcagctgacaggatttctccacttcagccaggcgcagcatatccggcaaaatgtctgccagtgattttaccgcaccatccaaatctccggaagtaaatgcaaaaccgtaagaataaatatcatttgcatcagcagttcttgtctgtgactggaataccggaatatcaacgctcattacgtttttctttcccgcttccagataaacttcctgctttggtgccatcagcgcagtatttaaaatctgttctgacattccggcttttgcaatgacaaagttcttatttgcatttgcgattccctcttctacttttaaacgcagagccatgttttcccttgccaggtcaaggaactgacgcatcagttcatcacgtttatcctttaaaagtttgtgtccttttacggcagtgactaattttttcttctgcttgttcagctccattctggttggatttatctgggtagatgccaaatccaatcacctctttcaacatttgccgtaatattcgtccagatacttgtcatcgatacgtttcagttcacttctaggcagtaaggaaagcaatttccatccgatacgaagagtttcttcgatatcacggttcgcattatatccctgtgaaacatattcctgttcaaatgcatctgcaaattttgcataaattaagtcgatatctgaaagtgctgcttcaccaagaatagtcatcagctctttcgcatctttaccacgcgcataagctgcaaataactggttcattgtatttgcatggtctgcacgggttttaccttcaccaatacctttatctttcagacgagacagagatggtaatacatcgattggcggtgttacaccttttctgtaaagttcacggcttaagataatctgaccttctgtgatgtatccggtaaggtcagggattggatgagttttgtcatcttcaggcatggtcagaatcggaatcatagtaatagaaccattacttcctctcttacgtcctgctctttcatacattgttgcaaggtctgtatacatgtaacccggataaccacgacgtcccggaacttctttacgtgcggcggatacctcacgaagtgcatcggcgtagtttgtgatatcagtcagaataaccagtacgtgcatatctttttcaaatgcaagatattctgctgcggttaatgccatcttcggtgttgcaatacgctctaccgcagggtcatttgcaaggttgataaacagaacagttctgtcaatcgctcctgtttctttaaagctttcaataaagaagttagattcctcgaatgtgatacccattgcagcaaatacaacggcaaagttttcacctgttccacgaacttttgcctgtcttgctatctgtgctgccagctgtgcatgcggcagaccggatgctgagaagattggaagtttctgtccacgaaccagtgtgttcagtccgtcaattgcggatacacctgtctgaataaactcttccggatacattctggctgccggattcattggcagaccattgatatctcttctctcttccgggagaatttccggaccatcatcaatcggacgtcccagaccgtcaaagacacgaccaagcatatcttctgatacaccaagttccatgcttcgtccaaggaaacgtactttactgttggacaggttgatacctgttgaactttcaaataactgtactaaagcgtccgttccgttaatttccagaactttacaacgtctggtttctccacttgccagctcgatttctcccagctcgtcatagtgtacattttcaacaccacgtactaacatcagaggtccggcaacttcctgtatggttctatactctttcggcattttagaagtccccctttcctaatacattcgcaatttctgatgccagttctttttcaatgcggtcgtattcttcatctaatttatcttctgtcacatatttgaaacgtccgattttttcacgaacttccattttaagcagtccctgaatggaagcacctttttccaacgcttctttggactgttcataaaatgctacaaccagctgcatcagcaaatgctgttttttcagtgagctgtaggtatcaacttcatggaaggagttctgatgtaagaagtcctctcgaatggaacgagccgcttccattttcaaacggtcgcctgcggaaagtgcatccatacctaccatcttaacgatttcttccagttctgcctcatcctgaagcagacccattaatttctgacggttttccatccaatccgatgcaacctgtgtattaaaccaatcttccatattgtcaagatacagagaataactggtcaaccagttgattgccgggaaatgacgtttataagccaatgcggaatccagaccccagaatacttttacaatacgcagggttgcctgagaaaccggctcggaaatatcaccacctggaggagacacggcaccgataacagaaagtgctccttctctcttatcttttccaagagaaattacatgtccggctctttcatagaactgtgccagacgagaaccaagatatgccggataaccttcttcacctggcatttcctccagacgtcctgacatttcacgaagtgcctctgcccaacgtgaggtggagtctgccatcagcgctacggaataccccatatcacggaaatattctgcaattgtaataccggtataaatagaagcttctcgggctgcaaccggcatatcggaagtatttgcaatcagaacggttctttccatcagagactgacctgttttcggatccttcagttccggaaactcgtttaatacgtctgtcatctcatttccacgttctccacatccgatgtaaacaacgatatctgcatcggcccattttgcaagctgatgctggattacggtttttccactaccgaatggtccaggaaccgcggcaacaccaccttttgcaattgggaagaaagtatcaacaactcgctgtcctgttacaagcggcatttccggaggaagttttttcagatatggacgtccacgacgaaccggccatttctgcatcattgtaagttcttcttctccgttttcggtttcgattacagcaaccacttcttctactgtaaattcaccggctttaattttttttactttacctttgattccgtaaggaaccatgattttatgatttactacaattgtttcctgaacagtaccgagaatatctccggcttctacttcatcacctgcttttacaactggttcaaagttccatttgatatctcttttcagagaaggaacttcaacacctctttttaagttagttccggaaactttcatgatatcatcaagtggacgctggattccatcataaatactggtaatcaaaccaggtccaagttctacggaaagaggtgcatctgtagattctaccggttctccaggtccgaggcctgatgtctcctcgtaaacctgaacactggcttcatcaccatgcatctcgatgatctcaccaatcagacgctggttacttacacgaaccacgtcgtacatatttgcatcgcgcattccctctgcaataaccagcggtcctgcaacttttttaatcgtacctttgctcatgggaacgaatcacctgctttctaaaatattcgtatcgtgactttaattaatcatcacgtttcacttccaaaaaggatatccgagccaacagcctgctctacggatttcttcacgccttccacaccatcgcctgtattaccggaaactcccggaatacggataacagcagggaaaagctgctcctgaaatttttcgattattttttcacactctgcagccatcgcttctgtaatataaataattccatattcatttgctgcaagtgtctctaatttttcttcggcctcttttcgggatgttaccggaaacgtgtcaagacccagcgccgcaaagccaaaaatgctgtcataatcacctactaccgcaatcttatacatacatttcccttaccctttcccgaatagaatcatccgacagtccgctgcgcttaccggacacaatgattcgtaccgtttttatttcattttcccttgccagcacataagctaccaaaggacctaccgaaaacgactgatatttctgaggttgcatggtctgcatcattcggttgtcacaccaacgttcaaatgcggaagctgattctgcaatcgctcttccaccttctgcatactctgtctgggaaagatactctacaattgcatccattccactgactgctgcttttgcaagctgggttacacttaatgattcacattccgccatcgcacgcttcataaattccatagattttgcggttttctgtgcacgcacggcaatcttaatatcggcaatggcaactgtcgattcagcatactctttaataatgctgtcctttgcctcttttcctgcctgatagacagcttcgagctgtgccttgtctatgatgatatcacaaagctgcccgtctctggtatgaagcagtgcctcataagcttcttttgccgcttccgacattatctttggaagtctggaaaaatctttgcttcttacaatctcaagcatctcatccggactgatggaagtatcttcataataaatatttaaatgctttccactttcagatgtacacgcatctttaattgcagcttttaaattgtgaaacagattcggataagacaatacatcaaatactgacatatccacccctaaatcacggattgtctcccagattttttcctgctccctgcttaatatcgcctctgcattttccggtgtatcggcatctccccagcctttttcctgaagcaactgcaggcactgcacatctgtctggcatgccatcagctgttcaatcaccgctgaatttaataaagatgtctctaacgcacggattcgcgcaaccgcataagtgtattttgtatcaatcaaaacaagttcctcctttttgcggttatcgcttatgaaaataataatacatgaactttatcggaaagttcacctttcttggaatcgaacattgccttaaaggtacagttttcttcgattcctccatataaaagaacaaaaccgccgcggatattatcatttccctcttttaacagagtcagttttccgccttttttggctgcaatgtccataatttcgctttcaaaattttccggcattctctttaaatcattggaagagaagcagatgcttccctcctgtggcagaacgaattttttcagcattttgcggataaattcaaaataagatttatcatctaacaccaacagtgcttcataaacgtcatcgagaatctttgcaatcacttcctgttttgcctgaagaattgcttttcttttctgcaggtcacgggaagatgctgctctttcttttaccgcttcgagttccgcctctgattttttggagatacgcccacattctgcctcagcattttcttttgctgtctgcattactttttctgcatcctgcttcgcttcatccaaaattttctttgcacttagctctgcttcgttcagaatctggcttttcattttttctaatccagtcatccctgcgctctcctttgctctttttctttcctgtttctatttttcgccctataagttctgtaaaattagaaggacaggtttgttactgaaagaatagaaatcagaagagcaaggattgcataagtttcaaccattgcagggaaaagcattgctttaccaaactgttccggtttctttgctacaataccgattgctgctgctgaagtcattccctgatatttaccggaaatcagacctacaataccaatcggaaggcatgctgcaagtactaaaagaccctgctgaggtgttaaatctaacattccgccacctaataaaccgattttagaaagtgtaataaatccaactaacagaccataaataccctgtgtacccggaagaagctgcataatcagaactttcgcaaatttgcttgggtcttctgatacaactcctgaagctgcctgtcctgcaatacctacaccgattgctgaacctgcacctgctaaaaatactgctactgctgcaccaagtaatgcataaacaattcctaactgactcataaataagtttcctccttaacatccacgtatttcgtagttaatttaaatgggttaaatggctttccgccaccctcgtaaaattttccgaagaattctacaaactgcaaacggtttgtatgcacataagcacctaacaggttaattgccagatttaatgtgtgaccaatgataaatacaacaataaatccgattgcaccaagaattccatctcctaacatacttcccatctggtttacaaccgatgcgataactcctgtcgcaagaccaagagctaacagacgggaataagaaagtacatcacttaaccatcctgttacgttataaatatcataagctccaagtgccagacgaagtgcaacatttttatttgcacgtccagacatcagaagcagaccgactgcacctgcgattgccattactttacctgtcacagaaactgccggtgggaatgttcctgccggaatctgtgagatagaagcaaagattgaacttggaagcagcattaaaatcaaaccgattaagaacacataccagataataacatcacagaagaaatccatatattgtttttcttttgctaacatatatcctttaattccaagtcccataaacaggtgaatcacaccaaacagcatggagtacattaaaaggcgcatcggatcgttaagaggaacaaaccatactgccttaatcaatcccgttgacggcacatctacgtggaagaatgttcttgcaaccacgtcaatggcatcaccaaagtatccgccaaacaggacaccccatactaaagtggaaagtccacaatacataaacattttcaatgacttatacattccacgctccatgcgcgggaattttttgattgcgatgaaacaggccaggaaaataaccagaccataagccgcatcggaaagcatcagaccgaagaagaacacatagaaaaatgacataataaatgtcgggtctacttctccttttttcgggagaccataagattccagaacaccttctacggattcagaaaatccattgttggaaagcacaacaggtgcttcttcctcttctttgatttcttcaatttcgacaactaaatcatagttctcttccatcgctttttttactgcgtttgctgcttttttcggtacatatccgctgattaaaaatgtcttttcagactgcggaattgtgcctaatacttcatatttctgtgctcttgtacggaaataatcggaaatcacacgcaactgtgcacgcttatctgcacattctttgatatgattctgacaaacttcaatctgtttttccaaaagtccaatttcagcagtcagattttcctgctctacttttggaatttcatcacacagctgagacggtcttgcaaatccaccctgtctcaatgcgttttcaaccagttctgcttgctctctcagacaaagtactactacataagtactgtctctgtctgaggaaagaatcgtaacatctacaccttcgacatccggtgcatgttctgctgtcagtgtataaatttcttccagcgtcataacacttgaaaaacttccaatcagagcttttacgctgccggtaccttcaaaattcatcggtacatccagactaagccatggacttaaggcttctatctgattttctgttttctgaatatttgcacgacattctgcaatttctttctgccagccaaccaaatcagataccacatccatgatgtcttctttttttgaaatactctctgcgtatttttctttttcaattagtgccttgccctcaagactggacaaaaaggaagttttttccggtgcatattcctgaagaatctcaagtgcctggtctgcagatgacgctttcttttcaaagagaattcttgttccctgcgtatcctgcttctcaaaaccactttcgtcctcaagcacctgactgacttccattactcccatggactgcagtctctcaaggatagatttccggtcctttttcagtgcgcagatactaactcgctgcatctgcaatactgccatgttcgcatccctccttttttgttttgttaaactttaagcggatattttttatttctaccgcttcttccggtgcattttgcactcagattaattcggaaataatcaaatcaaccgcttcattcttgcggcctattgccgcagctttcatgctttcaatttctttctccgtctgttttaaagcttcgtctgtgcgttgcttttcggagttctctgcagattcacgcaatttttccgccttctgctgtgcttcagaaaccatgtccgcatacagttttttggaagcttcctctgcttcctgggatatttttaagctctgacgtttggcttcctgcaccatttcatctgcttttttctctgcatccctgatttctttgattgttccttctatcacagtatcaccaccttcacatattttaaatattactatgctttatgcattttgtcaatattttaacgtacaaatacacattttacatcattattttagaataagcacaacacgcaagaaaattcacgtcatactacccacctatttctgtatttttttgtatattttgccaatttccattcaaaaaatgaaggtgtttcttcttattataaatgtagtactttagcacaaaaaaatcgccctgtatttattcaaaaatacaaggcgatttttttactctatttttttatctttacatttcgattgtaaagcggacattcgcaatccgcttcgctacttgctcataaacgcagtcgctttgcgatctgtcagtgggagctttcaactctcactgacagaagcatccccctcacccgccgcttagtgctctgcgcacttgaagcaggggaatgcttatctgcgttcaatttttaatcatacaaataattagcataccgctcatcggaaatattttctgaatcaatccattccattccaggattaatactttcatcattttccattccaagcgctgctcttgctgctgctacaacagttgcatagcccattccataagcattttgtaccagcactccgacttcttttccagacttaatggcatctttttgtttctttcccgcatcgattccgacaactgccacttcttttccggatgcagagattgcatccagcacatcccctgacacattttcattggtacagaaatagccttttacatccgggaacaattttaacacactttctgccatctcgctgacagaagtttcttcattttgatgggaaatatttacaatctcgatatccggatatttttctgcaattgcttcagtaaagccctgctctctttcctgacagttctgagcactttccacatgcgtcatcacagctattttcccacttccgccgattgtatctgcaagctttacagcagcttgtactcctgcctgatagttatccacaacgcaggttgcattgacatttccggttttcactccagaatctaatacaatcaccggaattccattttcttctgctgcttcaagctgagcctgacaggaatccatgtcaattgcagaaaggcataatacatccggattttcaccaagcacagcatcaataatgttaatctgatcctctacatctgtttcatctgacggaccttcaaaggtcagctttattttgtcatcacctttataacccagtttttcatttaaatcagccactgctgcgtccataccgcgcttaaccgaagtccagaaaccgctctttgtgctctttactaccactgcaatatgacttccggcctctaaattaatttcttctaaagaagtataatcaatcgagcttccattttcacgaagcttttgcatggtcaaatcatccttcatatcatcgttctcggcatctgtattttctgactcgtcaccttctgattttgtatctgttttgatgtcggttgatacattctcttgattttccgtattctctgcaccttttgagtcattttttgatgtatcgtctttttcgttctcgttatccttgtctgtctttgtctctttttcttctttcacactagaacttgccgctgtttcactcttcttgctctggcaggaagttatacttcctgttgcaagcactgcacataataaaactgcaactgctcttttcatacactttttcctccgcttttttctccaggtgtttctattcttctcactacactattttctcagccgataactcctgtttatatgagtgagttatcaaccagtttgtatcccaaccacgttttcattatacacgaaacagtttttgtgtctataggtattttgtgataaatttgtgaagaaatgcactaaagcagccaggttcaacgtgtaattaagcaaaatcgcgtatttttatttatttcatgctgtcaagctaccggaaaatgctccggcgtcggaagttcaaacttcatctgttttttcgtaatcggatgcgcaaaatttaacttatacgcacagagtgcaatctgcacccattcctttgttccgacaaattccggattgtacttggtatctccataaagtggaaatcctgcattagcagtctgaacacgaatttgatgatgccgtccggtaaacagatggatctccaccaatgccatttcatctttttcttttaacacctgatactccagtactaccttcttctttcctgcctcagattcttttgcaattctcgacgtattcttttttgcatcttttatcatccagtcttctaatctgccactctttttttccggtatcttagatgtcacagccagataatacttatccatctttccgtcctgcatttgtttattcaatcccgccgctgattttttattctttgcaaaaacaaggattccctcaaccggctgatccaaccgatgaatcaccgcaagatacagcggctctttttttctcgccagatatccgagcagggcatgctccatatcctgacttccaacctgtctgctctgcaccggcatgcccgctggtttatgacaaaccagtaaatccttgtcttcataaagaattgtgtcctcaattactgtatatcccattttatttttcctcgtctttccgtctccttaatgtattctgaaaattttattcttctgcgcacacaaggacaaccgccataccttcaacttttttcagatacaacggttgccctaatgatgttctgcgttattcaattttaataattcctctcttttttattatttgtattgttattttttatttaacactaatacctgttcttataaaaaatttggaatgataattggttatttagttcctcttaattttattttactatattcaattatcaaatgaaatatcttttccggtttctctctttattccccattttacaacttttattttcttttcttagaatatagattggatttctttacatccttactttttattcttagaaagttaaaataatattgctgaaagttcatatcatctatattgataataaaaagcttctttcaaatatcccgagcatttgctttcaaaacatttctttatatattttttcttgatataaagttctcaggaaatcaaaacaaatattttcgattataagtatataaatatctatagataccaactgattaaaaccgactttctattttttactctatctttgtttttcttgatttcatacctttgaaggatatataaatactctgttttttcaaaatatatttctttacatatatcttgaaacctttttatcatcttttgtggtaatgattcaatatgaggacatttttgatattttacctgatttttatttttaaaatcttattttggaatttctgaaaatttcctaatggaaatcaggtctttcttagggaactatgccttaccactctcatactgataatttgttgtctctgttatttccaatggacgttacctccttatcaatatttcacgattccaccttttactttatccttagtacttctctaattatgatttattcctattatatactctccatacacttaaggaaaaatgataactatcgtttgtaccttgtagccaacttcctaaatagatttctcttctcaatatctaggaattggttatgtagtaattggtgttttcttttgatggttatatattaccatgctaaagcatatttgtcaatatattttttataaaaagttttatttttagtaatttattttttatttgatttttattgctgtaaattgtggattattttttaaattatatatacaatttattttatatctaatctttcgagcaattacggcaatagctctataattacacagtaaagcggacattcgcaatccgcttcgctacttgctcatgaacgcagtcgctttgcgatcaaaaagaggatgccattctcacagcatccccgttttaagtatttatcctctataatagttgattaaacagcctttcaagataatctctctctcatcatctgtcaaatcgcctaattttaatgtaaattcttttaatttatcaccgactacataagccttgatttcgtcccatttttcttctactgcccggcgaatctgcggaacaaagatataatctttattcttaaacggcagttctccgtccgaaatcaagaatggaagcatgccccagttaatcagattggaacggtaacgtttggttgcatactcgtttgcaatatttgcccatcctcctaatactttctgacaggatgccgcctgctctctggcagagccgtcaccaggtttcactgcaaaaatggtacttccgattccggtgttttcactgttcatgtccgggaaagaatccttaatcttatcccataccggttttaattctgcaactgcttctaatgggcagtttccttcttctcttgctttttccgctttctggacttcttttgcaagaggaacataatccgggtcttttcttgataatgcaaattcagccagtttcagtggattagaacggaaagaagaagtttcgccggatggaatcagttcatccgttgttgtaaccgggtcatgaatttcagagactactttcaataccagattatcggtcagtgcacacatttccggccagtctttgatatttggaccaaactgaatttctgtgttcgggtctgctatacccttactgtcaaagactctgttttcataaattgtcttatcaaagaaataacgcggtttcgtatattttacatcaaaatctgctgcggaagtaaggtaccccttatttgctgcagttgctgcaatggaacgtgcatccatcaaagcgacagaagaaatctgaccattttgaatcttagaaccttcacgatttgggaagtttctggtagagtgacgaatactaagcgcattgtttgccggtgtatctccggctccaaagcaaggaccgcaaaacgctgtttttacaactgcacccgtctgcattaaagaagccagcacaccattttttgcaagttccacataaatcggggtacttgccggataaatgcttaaggtaaaggcatccgaaccaatgcttgcaccttttaagatatcagctgcatcacagatattttcaaatccaccacctgcacaacctgcaataattccctgctccacataaagttttccgtcacgaactttatcttttaaagtaaatggaatcttgccgtccagactaatctgggctttcttctcaacatcatctaaaatatcatataagtttgcatttaactcatcaatggtataagtgttgctcgggtggaacggcattgcaatcatcggttttacctgacttaaatccacataaaccatgccgtcatagtaagtcactgcgcccggcgcaagttctttatattcttcacttcttccatgaacctcatagaactctttaatcttatcatccgttacccagatagaagacagacaggttgtctcggttgtcataacgtcaattccgattctgaaatctgcacttaaatttgcaactccaggtccaacaaactccattactttatttttcacataaccatttgcaaatactgctccgataattgcaagtgccacatcctgtggtccaacacccggaatcggttttccggtcagatagacaccgacaacctgcggacgacgaatatcataagttttagaaagtaactgctttaccagctctggtccgccctctcccattgccattgtaccaagcgcaccatagcgtgtgtgactgtcagaaccaagaatcatttttccaccgcctgcaagcatttctcttgcaaactgatgaatgactgcctgatgcggcggtacatacattccaccataacgttttgcgcaggtaagtccaaacatatggtcatcttcattgattgttccaccgaccgcacaaagagaattgtgacagtttgtcagtacataaggaatcgggaatttttccagtcctgaagctctcgccgtctggataattcctacgaaagtaatatcatgagaagtcaatttatcaaatttaatctgtaaatcatccatattgccggatgtattatgtttttcaagaattgaatatgcaattgtctctttggaagcttcttctttggaaacaggtgctttgcctgtcaaatttgcaattactgctgatgcatctttattatcttctacaatttctgtgccgtttaccagccatgcaccgccattatacaacttaaccataaccatactccttcattattattggtgtattttactagtgaactacccatcttctatatgtaatgggcttctaaggagctgacgctcccatttaagaagtctgatatttaagtttccacctaaccaatcaggcactccttattcttacaggcgtgtccacctcgcctctgctgtataggatattcctatccacaacactacttttacgctctaattataaattttattacggtaaaatgcaagcattttatcactttattgtatgaatttaattgtatacatgagtgcacgtattcttttaaagcataaaaaaatacttcccgacttttttaacaggaagtacttttcttattttctatcgtgaattacttggctgcaagcaaccaagcttttcgcttaaatcaggaaactatatcagtcctgattgttcataaaatccatgtaactggaaaccataagcgcaatcttaaaggtcaatgcgtcatcaaatacacggatatcaagtccggtgcttttctggattttttctaaacggtacacaagagtatttctgtgcaggaagagctgtcttgatgtctcggaaatatttaagttattatcaaagaatttattaatggtatttaaagtttcatcatccagagattccggaagctttccaccaaatacttctttcatgaacatttcgcacagaggcattggaagctgataaatcagacgaccgattccaagattattgtaacctacaatatttttttccacatagaaaatctttcctacatcaagtgccatctttgcctctttgtaagagcgggatacatctttaatttcatggatgatatttccataagaaactctcgcttttgccatcgcctcagaattgagcatatctacaatcattcttgcaatcgcttcgatggattcataatcgtcgctctcttccagattacgcacaataataatatttttctcatcaattgccgtaataaaatcattgcttcttgaaataaacatatttttcaggatttcaatcgcatcctgatctttctcgtttcttatttcaaccagaataaccacacgttttgcttctaccggaatgtgcagtttttttgctctgttatagacatccacaagaagaagattgtcaagaatcaaattctgaataaagtttgatttatcaaaacgctctttataagccacaatcagattctgaatctccgcaactgcaacacgcccaatcatgtatgtgtcttcgtttccaccttttgcaatcaatataaattcgacagtctgaccatcataaattttgaagaaatgatacccccttatgacctggctatctgccatagattccacaaaactggatatatccccaaaatcctcatcttctatcggaaaagtagttgaatttactttgccgtctacgtccatcacacataaatcaattcttgttatgcttctcaattcatccagtgtcttttgtatcacctgacttgatatcatattgtatcctcttttctctgtatttttataagtttctgtcgccgtaaaaccacatgcctttcggcgtgtggtagttcacatcaaaatgcatattatcacaaaaaaacttttcgttattttttatataatatcttattttactaaaatttgcaagaaatccaacagttttttgaactgccccaaccgactaatgcggatggggttttctgctctatagtagataaaaaaactgctgcggaatttccgcagcagcttgaattatcgtgaataacgaacaattagttagcgataaccagttctgtttctttatcaaatacatgaattttttccatatccagagcgaatttaactttatcacctgttctggcagttgtacgaggatttactcttgctgtcagatggaatccttcgatatcgaagtataagtaaacttcagcaccaagtaattcataaacagtgatgtcaccttcgattacgctttctggatgagcagcgatagccatctgttcgtcagatacatgttccggacgaataccaagaacaacagtttttccatcatatccgccgtcgattaatgcttttttcttagaagccggaacagacagagtagttttaccaatctgaagtgtaacatcttcaccttttacatggcaaacagcatctaagaagttcatctgaggagaaccaatgaatccggcaacgaacaggttgcatgggttatcatacagattcttaggtgtatcaacctgctgtacaacaccatctttcataactacgattcttgtacccagtgtcatagcttctgtctggtcatgtgttacgtagataattgttgctcctaatctttcatgaagtttggaaatctcagtacgcatctgaacacgaagtttagcatccaggtttgacagaggttcgtccataaggaatactttaggttcacgcacgatagcacgtcccatagcaacacgctgtctctgaccaccggaaagagctttcggtttacgatctaacagtttttccaggtcaaggattttagctgcttctttaaccattttatcaatctgatcttttggtacttttcttaatttcagaccaaatgccatgttatcgtatactgtcatgtgtgggtacagagcgtagttctggaataccattgcgatatctctgtcttttggttctacatcgtttacaactttgtcaccgatttttaatgtaccaccggaaatttcttccagacctgcaatcatacgaagtgttgtagatttaccacaacctgaaggtcctacgaagatgatgaattctttatctgcgatttcaaggttgaaatctttaactgcttcaaaaccatttggatatttttttgtaatatgctgtaatgataaacttgccattgttctcttcctcctaattgttacgttttcacgcttatgtttcgttttccacgcttgttctgctgttttaaacgtttttgtctcgttttcaactgctatcagtataccactgaccacacacatttttccataggtcaattaaacaaatattatcacaagtcttagttagcctctccaacgaaaatttcgccattgtcattctgccgaatttcccttcttcaaaatatgcatattgcacaattttgattggtaagacctgttttaaagcaagtttccgcgtttttttcttgtaaaattccaatttttttcttctttacagaaatctttttctttcttatactgttttaagacaacaatgtaaatctatgttactatgtttcgaaattggcaaaaacagaaagcgcaccaacacttatgcacgaaaggaaaattactatgtttcgattaatgggatgtatctataaagacgcacgtattttaaaaagcacggttatctgtgatgaatcagcttcaagcagaactcataaaattttctccggactcaattttatctgtctggaatttgaccttgaaaaaccaatctggctcgaatccaacatcacagattttcagcgtcattcaaaaacccgctttacgcaggataacttcattgaggaacttgattttgactatctctccattgaagtaattgaagagggctaactcaggataattcattagaagagagataatttattaattaaagtcagaccagttctcttacgaccaaaaacagggacacatcgctttcgatatgcccctgcccttttctcctaaatgaaatctattctaactcaaaaactctttaatcacatcttttacaatcttctcctcctcttcatctaaaagatgccgatagcgttcatccgtaagcgcagcttcccgaatcctcgcttccacctgttccattttctgctgctgactccgtaccgcagacggactctccctgcctccgtttcttgcccgctctttctgcgctcgtaaaagttcttccctgagcttctgctcctgctgtctcgccttactgcgcgccttcctgctcattttttttgcagcagcctttttcgcctcatttgcaatgggcggttctatcttcacaattcttcctgccgaatccttttcattttccatataatccagcagattcgtctctatcatctcctcctgataggcaatagaaaaaatcaggcgcagcattccatttactgcaccaagcaccacagttgttccaatcagcccctccatagccggcatgaaacttttcacaaacggaaacgaaagtgtcataatgcctgtccctctcacctgccatacgccaactgcagatacaaaaaaagagagaacaaaagctgtccaggaaaatccctttagcattcttacggaaatcttcccaatctttcgttctctcagccgtcttgccatataaaccgacggattgtgtatcgttatgtgattctgcgtatccctctgaaattcctgcagatacgcctgcagccatctgttcttgacctttggaatctgctgtaaatcctttaagactccacggttgcttttgtaaaccaccagcatggtgatgatacttaccagctcaaaaagccagattccgtaataaaacaattccacagacaaccctcctagtccgatgcacctcttctgcatctttatgagaccattatatagcagagctgtctgtttgaaaacaaaaatcgtacgacaaattcagtcatccatgcctcgaattttgtcacacccaccaggcaaagcggacattcgcaatccgcttatctgcgttcaaatttccgttttacagcatgagaagcagttcctctaccagtttgacagaatgtaaaattgcctgtctttcaaaagtcggataatccacctgtgcgctgtcatctgctttgtcagaaatcgcccggataatcaggtatggtattttatttaaatgcgctgcctgtccgactgctgttccttccatctctgtacaccagccattggttctctcaataatctgatttttcagagccttatctgccacaaactggtcaccacttacgactcttccctcaaatacactgatttccggatttactttctcgcaggctgtctttgccagttttcgtaaagtttcatctgccgggaaagcatgaacatccatacgcggaacttgtccaatcggatacccaaattctgttgcatccatgtcatgatacatcgtgtctgtggaaagtacaatatctccaatgttgatttctgcttttaaagaacctgcgattccggtattaataactgcatccacctgataatcatctgctaaaatctgtacacagattccggcatttacttttccgattccggaacgaaccacaacaacttcttttttatttaatgttccatggaaaaattccattgcagctttttcctttaccgttacatccttcatctgctcttttaacattgctacttcttcttccatagcaccgataattccaatacgattcattttaactttatctcctttatttcctttatcttagcctttttgctattttcatcataacacacttgcaaataaggtacaattcttaatccttaacttaataaagggtgcagactttttcgctctgcatcctttttcctgattttcatccttaccttttctattctttcttttcagataagtgttctgcctcatcctcatctttttcccgcttcgagtttatcacagaggcaattccatgcagaatcactgctcctaaaattgctcctcctgccagaattttcccataaactccagtcagcacaagtgcaatccctccgacttttggaatcgaataagcaacctttccaataaaattatcatacggcgccgggttcatatcttttgttgcattagcatcaccttttgtgataaattcacccatcagtacacgattttccacaacgcggtgcgtaataatagaagccgcatcctttgttccataaaatgcaatcacatcatctacctgaacatcctttggctccatctctttaatataaaccagacttcctgttggaatcgccggctccatacttccactgattactgtataaacatgataatgaaatgcttttggtacggtaagcggaaggcagattacaattaatagaattaataaagcagtgcccagtgcactgcacacagcagccactgggcttttttttgttttttttgtattcaagaccaataagtcctttcgtcatgttgtatgcttatttctttttagccatgtatttctttaataatacacccattccggcaagtactgcaaccccacagatgccaatcgcaacacctgctgcaacaggaaagccttttttcactttcccctgatttatatctgcgtctctggaaagaggagtctcatcttcgtctaaatcctgaatctcctgtgttccctgtggagtctggtcttcttcaattgtctgggtatcctgagtactatctgttcctgcgtctgtatcagtcgttgtatcggtctctgttgttcctgccgttccggcgtccgtatcagtcgttgtaccggcatctgtgcctgttccggtttctgtcgttgtaccagctcctgtaccggttgtgcccgtaccggttgttcctgtaccggttgttcctgtaccggttgtgcccgttcctgttgttgttcctgcggatgtcgtagccggtactgtaattgtttccacatttgttgttcccggaacaactgttgttacagttgttgtctctcccggaatcgttacaaccgttataccgattggcgtataacggaaggtaaatacattttctgcggaattttctgataacgtctttgtaagcgctaatgcctgaggagtatatccttccacatactgataagcaactaccggtttgtcacccacatttccataataggtattgcttgcaagcagttcctttccatttgcatcctgataattgactgtataagcaacctgatttcctttgattccataagcaactacataatcggcatcgccttttaccgtaacactgtatctcgaagcttctaattcatcggtttcactgttatcacgtccactcttacgaagcccttttacataatatttatcgctgttatttaacgttaccacaccatctttctgtacatcgaaagatacgaaagctccgtattttagattgctcatcacaatcttacctgctccgtctgcaaatgtaccttgatttccggcatagaatgtaacggtataagtatattcgtcatctgcgaaaacagaaagcagagaacactgaaacatcatgcagaaagccactacaaaagttaaaatctgtcttaacttcttcactgtcctcactcccctttctcatcctcgcgacgtctctttactgccaaaaccgcgataatcaataccacaattccactcaccagtgcaatcgcactaaacaataatgcatgcatggtatcaccggtctttggacttgtcaccgctgtttttcggattgtcgaagattttccggtcattgtctttttgactactttatttttacccttttccacttttgtctttttggaaactttttcaactgcaaaatttaactgtaattttgcaagtgtattctgatatgcatttccctgagtttcaccctcaagtccgacttctaattcaactgttcctgtttcattcttatccagacgatccagatagaaataatcttccatggaatttgttgcctgatgaagaccttcttctccgcttttcttatcctctccacctaccgtatcactgtcataaagtacggtttcttcaccggaaacatctttataagaaagtttgtaagtataagcgccattctccgcctgactctcatcttccagactcttcaggatttcattggacatataccagtctgtctgaatgctctctgagtttttaattttcacaccaattttcatggtatcaccaggaagcattccataaacttcttctgcgatctcttttgagctaaagttactgtttagcttatcattcttaaaatctaccgtccagtctttactacttgtaatctcttctgctttcgcagttgttaccgtgccaaatgtcataacagccgccatgaccaggcacaaaatattcttttttaacatatcgtgcacctcctgtggctactgtaagctgatactgtttccgtcttctgagactgtcacatcaatcccccatgcactcttgattgcatcctgtgcattgtgggtctgtacggcatcggcttctgcatcaatcgtaaaatgatatccatcgtattcataaatggttttgatggtcttcttgccctcttcttcggaaaccacctgttcctttacctttgttccgatagaagggtcaactgttaatgtatcactaattgccggagcgctttctcctgccggcaaaagcctggtataataaagtacggtacgctctcttgttgttgcactctcatcaatcacccagccattgtctgtgagcagatttaaatcaatcaaatccggagaaagtctggtatttttatttccgtctgcgtcagtccagctctttgtaagaatgacccttacaaatgtatcaatcgagccgctgttttgtacggttaaggcttcatcgtaagcttttccaagcgcaaatttctcatcttttccaaccagatttttaagaagttctccatgttcttcaacccactgattatccttgttgtaatctctcttactgattgtttcaccattttctaaaaggctgataccaatctttgaaacctctgcctgcactgcataattctcactgtaataagtcagtgccgctcttgtacttcccacggtactgccaagaattaaaagtccggccaccgcaaacaggaaaacgggctttacagaaaaggattttttcttctttttcattactcacccacctcctcagtctgcgcaacatctgctttctttgtccagtctgcacttggatttccctctacatctaagataacaggtgtacattctgaaacaacaattacattaaaatcttttggaaggttcatgttactgatttttaccaataattcttcgctctttgccccaggtgctataacatcagaatagtaataatatccgtcatcccccggcgtccattttccactctcatcggagtagaccagtccttcctgatactggcttccggcaaatacttttactcttacataacattcgtaatcaccggtattttcaattttgatatgcttcgtccaatcactgacctcttcatccggaataacctcggtaaatccaagacttaattcctgtccaccctgtgctgtcacataagtggtaaagtaagccatggcacttcctacagaaagccctgcggtaagtgtaagagctgcagcagtcagacaaagcgttttcttattcaactttttcttcattgcttaacccctccccttattcctgtgcctgtgtactgtccgtttgctgttcccagtcccagacaccatcttcggctgactgtttctggtcatctgcggtttcctcatttggagtaaattcaaaatgattgacaacacttgaacctccatttaatttaccatcatactgattttcaaatgctgtggaaaccatttcatccgctacgatttgagtggtctgctctgcctctcctgttgcctcataacttgaaccactgtaaacttcggttaccgttatatttgcgcccgccggaagttcctttatcacaacactctttgtgcctgttccatcaaataccatggaaactacatcactgtaaacgatttctccatttacttctgcttcaatatcaaatacaaacgaagcacctttcattgtctcattataagaagttaaagttttatcgatttcaaggtcaccatatcgttcctgttggtctggttttaatcctgttgatgtatcataaagccactcgtcgcttccggttacataatactgattattcggcagggaaatcagatacggtgtaaaactgtaagtataatatggagactgcacttcttctgcctctaccagatacattccgactgaaagcccatccacactgcccttgcctccaatcagattatcaaaagctgttgcctctgtctggttctcttctactgccttcactgcactcttggctttctcttcccattcttgtgctgttgtcttgctgctgatggaatccagtttcaattcctcaaatccggctaaggcctgatactctccatattgattcacatctgctaccttatacatgcgaaccggaattgtcatattctcccctgaaagttccggataaaccgcatccagctcaaatttcacagaacactgccggtcagtttcaatactgatagcagcctgaactttggacattactacggtggaaagtgtcaacaccagagccagagccaatgcgcttcctttttttagttttttcttcatcttcacatttcctcccctctgataacagataagtaactatcctgtactgaaaagtctttcttgttctttcttattcttttttattcttttttgtgtttcttctttccaggtttaatcaggaacttcatcaaaagtattacaagtaaagttaccgataatccaagtatcagataaatcatgtagtaattctgaattgatttcaacatggattctgcggctgtagattctatctcttcctctccgttatacggtactcttgtgccacgaactaaaagtctgtgagagtttacaccgtacggcgtacaggtaaatagcgttacatgatcctgaccctcttcaatctggagagccttttgaagcgtctcattgtcatccttatccaccatatctaaaatctggtcaacctgataagcaagcgtttcatccaaaacgtgaatgtaaaacatgtctccacgttctaactggtcaatatccgtaaacaatctggcactcggcagacccctgtgtgctgccagtacgctgtgtgtgctctccccaccgattggaagcttggttccatttaagtgaccgattcctgtctgaagcacatcatccgctgttccatgataaatggacagctttacattaatctttggaatggatacatatcccatgacaccatcatttcccacatttaaaatctgccagtattcggtatttttaatatcgtctccattttctccaaaaacatcaccaaatatattgttatggataatcgtatcattaaaagcattcgctttttcccattcctttgtaaaatcctcttctgccatctttccgattaactcttcataagatgaaatcaattgattctgccggtatgtattccactggttagaaactgtcggataaatcaagattgcaaatcccagcaggaacattaagccaaacaaaatacctgaaatttttctcttcataatacatccctactgttcctttgattttctcttcttatcataacaataaagtataaggataaagcctcctgttactgccagtccgataactacccacaacccataattggtatggagactgactcctccaagtggtgtggatgcctcttctatatcggctgtcttgtaatctactctgtgtcctcgaaccagaagtctgtggctgttaactccataaggagtacaggtaagaagtgttaccaaatctttctcttcctctactgctaaatcatccgtttcttttggttcaacgactgaaattttatctacttcatagcaaagcacgtcatctaatatatagagaagaaaatggtctccctcttcgagtttatcaagatctgtaaaaagtgtagcactcggaagtcctctgtgtgcagaaattactgcatgtgttcctttgcctccaaccggaagtgaacttccttcaagatgaccggctgctttctgaagcacctcgtcttctgttgtatgatagatgggaattttaatattaatcttaggcacttctatatatcccatcataccatcaccaccaaggttcaaacaagaaaaataattagaattttctccatcggaagcctctgcgactgcaaaagaatccggaagaacggatggctgaagagaatcattatatgcatcggcattttcccattcctgctcataattaatttctccatctttttctttctgcgcaacaacttcttcataaccggatatcagctgcttctgcctgtgattgttccactgatttgcaaccaagggatacaacagcaaggacaaaccggctaaaaatataattataatcaatatcgtagtaacttttttcttcatccgggctctccttattgttgtattttttgtcaggtttcaattttctgtgaaatgaaaaaccaaggcgggcgagccgccctggttttttcacaaaataggcatttcaattgttacttattctatttcttctatttcattatttagcagattttttgcgagttgcgaagaataaacctgctgctgcaatcataactacacaaccaccgattgtgaagattgtagtaccgataccacctgtggatggtaagttggaaatcttggtgttgacgatttcaattttttcaactgttccgattgccggtgtatcatcagttactgtgaaagtagatcttacagtatggtcgtcgccggaaatagtagcaccatttacagaaatagaccaagctgttaatttacctgttgtttcgtcgattgtagcatcgattacgattgtgtatacggtatcatttaatgtgtatccgttaggagcttttgtttcttttaagtaataagtaccggctttaagacctgtcatggtcatctggccatttgcatctgttactacaacaccattaaactgtttgttttccggatatgctgttccatatacagtttcaagatcggcatctgtgtataaagtaaattctgcgccggcaagttttactttctgttcgctggaagttgttccaacttttgtgatgagttcatttgttaaagaaccatctgctgttccgtcaatatcaaatgtgtaagtataagttttgtcgttagaagaaccatctttgccatctactttagagtcttttgtgaagtttaaagtagcgtcgttgacatttgctacaccatttaatgctgcatcctgatttactgttgccgcataagttacaactaatgctttgctctgatactgattcagtgtatatgcattatttacaacaaaatcaactgtaatttcattctttgcttcatttactgttaatgtgtaatctgttcctgctgttaattctttaccgtctgctgtaactttcaggctgttttctttataagttaagccgtttaatttatccacgatgttgaacttcggataatttccaccgtagtaaggaattgttgttgaaagttcataatttactgtatcaccaatgtttactgtgttacccttaactttgttttcgccttcaacgatttttttgtctaaatcaggagtatcacttactttagcccatgcattttctgtatctgtaacatctacttcgttgaaatccattgctgtttttccatctttgtttttgtatactacagaaactaccaatggattataaattttattttcagcacctgagataacaactaaataagaacctacaggaacttctgctgtataagtggttccatctgtagaagtcatagcatattctgtacctgcaacttttgttgcatcaataatgtcagcgagctgagctgagtctacagtaatatcatcagcagttacatctgtaataatagttggatataaagattcatatcctgagaactttccgccattctcatattttgctttgataatctggtaagcttttactgtaacgccagtttcttctacgccacttactgtaattgttcctttgtcggatgctgttcctgttgctgcatttccttcggtttttccattcgctgcaaatgtcggaatactcatagcgagtaccattaccattgccaataccattgataacatttttttaagtttactcatactctctctccttttctttccaggatttcccttacttaattattagtttctcttgttacttggtttcccctttacttttgcgatttggaagtcgctgaaaccataatctcattttgttatttattcagcacctccttggatttgtttttatataatattagtgccgcagccatcataagcaatgcgcctccaatcgtatatcgatagataccagaaccgccggtacttggaagttcgtataccacctgattcttgattgttaatacgttcttctcatctgtggttaaaaaccacatattcggtttctgagtaagtggattacctgccatatcggttaaaataacctcacccttttcctgcttgaagtaaatcttattgcctaaaggcaagtaacctgttggagcttttgtttcttcaagataatattctcccggttctaaccctttgagttctatctcatttgctccatttttaacggttaaaacatctcccaatttttgataagcgttaccagctttcttatacagctggaattctgctccatctaattttaagtctgtattattttctgagactttcatcaaatcaaggtctgctgtttcttcctgataggtattcgtaagttctacttctgcatcctgaccatctgtcactgtataattacctgttgcaaacattgcccattgttttgatttatcaaagtgcataatgttttcaccgtcgtaagtaacctctccgtctcggaatgtcaacgtggaactaattttatccactccactaaagaaataacatttctctaaaactgcttttggtgaaaaattcattccatcttttctggaaatcaaatcaacaattgccattcttgctttgatacttgccggctgtctggtccaaacaaaatatccttcatttgaggttaattttgcaacgattaaatttacttctccaactggataatcccgtgcggaacatgttgttgtttttattgttgaagtatattcaattgtcgcctgcttaactgtcacatctgcactgtctccatttgaaccattaattgatggcgttacctgatatccatcttttttataattagactcgacaactctgtaagttcctgttgaacaattttccaatttccaggtgtaaacccaggttgtatctttccctgtcagattctcgtccagcttatctgcatccattgtaagcgttcttgtatcacttccatttgttacggttatctgatacgcaggatttgcttttgccagttctctgatctgcgcttttgttaaaccattaaatctcttagtcacttcaataaatggagcatccggctcatccagttcttttattttgtttgcaattgttacttgagcatcttttttcaattctatttttccatctgcaactctttgctcttctactttttcgtctgctgttttaatgtccgacttttcacaattgctgacagatttttcaggctctaaatatcttgttttatccagattcacttcttctaccagaaaacttgtttcagaaagaatctgtgtaacaatcactgtataacctgccggtattccagtaacaactccatctgcatctgttttgccacaaacaacactcttactgccatttgattccaattctccatctttgtagtaataataatttccttccccatctttaagatagtaatcaccctttgtataaggcactaacgtttgattagcctcattattagatagttgaatcttaaatgaaaaggtatcgtttgttacctgtccatctctcatctgctttgtaatccgaagttcacggctgttatatgcagaacaattatttacacaaactactgtcggtctttcttctactgtctttttatctgttttaacatccgaaatcgttccactaagctgtgcattttcatcaaatgctttatactcaacgccattaataataaccttatcatattgctgggcattcactccaacctctattacataatactttcggttagctttcagtccgctaaatattgctgactcatatggttttagataaaatacctttttatatgtcgtatcattaaatgttacatcctggaacttaactttttctgttgaatctttatacgttgcactatctaataattcatactcgtcatcgtaatacgtttcatttccttttggatctgttgatttaattttctgtgcatagacctggaaagcaaattttacattgctgtatttttctttatctgtgttttccagttcttttctaacttccacctgaccttccggaataacctgaagattaaatttcatgtgaagattagatgcacctgcaccacgttccatgtagaacattttaaaggaatggagagtataatctttcaatgtgtcgtcatcaaaacatgcttctatttctttatcactggttttactcgtccacttatttccattcggaagctttttagcatcttggaaaagttttttaatcgttgtcttatatttttttggtgtacctcctttaatacaatcataccagcttacctctcctgtattaaaattaatactgccggagtgagcatcatgaacaccaccaatatcaagcaccaagacgtcgtcgatataaatccataagtcatcatccccattgaattcatatatcatcgggtctttttgaccactaacctgtttagaagctattttaccatcttttggctgaaaaaaacttgcgcccatatacatcccaaagtaataattatttccatttgttttataaagtgtttttccttttgaactatctgaatctgataaaacactaccattttcatcatattcatttttattagttgatacgttttgactattaattgtgttatacggcataaagtttccacgtttataataatactgattttcattacttggtgtacccagtgcattgtatacggtaaaatttgtattgtttcctaaatatgcataattctgaaaactactgtattcataataacctgtgctgttatagatatcttttcggaataaatgatctacttccgttcctccgctaaaaagactcgccaaactttcattagcagttccgggaattgctgaacccgtagatttctgacctgtaatacaggtattcactcctgttgtaattggatagccatctgtgcctaacacattttttaaaagaccttttttaatacttcctgactgattgttattattctgccagtttccattattccacgttccggcacaatagcctcctcctaaatctatccaggtactactatccaaagcttttatcttatatttgttagaatccttaccttccatatcaatcattcgcattgtaatacccgcttgagcatgactgactgtttcaactttatccaacccggattctttatcggaagcataccaggctagcacataattagaaaaactatctgttataaattctgcctttgtaacttttgtttcacttgttgtctgtatatttgcttctttcttttcatcagccaccatatcgacaacccgttttactgctccattcttatcttcttcaagatgaataactgtaacatcaagatctgatttttctgtatcaacatcttccggtgatactccttttttatacttcatcgtaaccttgacatttccatccggctcaattttatttccatctttatctgtgagtgtaatatcataagccagaaatcctgctatagagtactcttcgtcctctgccttctgatttaatttttcctctacctcagtatattctgtcgtatctttttgaaccgatgttacacttaaggttgttccttctggaattgcaccttctttttcctctgtaatattaattgttacctcttcatcttcgtatgtaagtataggtttggtttcttttatttcagtttcagcttttgctgtctcttctgtttttgtctcttcttttgcctcttcttttacttcctctttaatttcttctttcggctcttcaactatcctttcttctgcctcagccgtttcttttacataacatccataaactccggacttttcagcttttaatagcaccttattaactgcatttttttcctgattcaagctaacatcggaatagatatattcatcaatattatctatactctttccttccgctttcagtgcttcctctaagtctgtttttgatgttatatttaaaatttcatcggattcttttttattttcttcggttgctttgtccagatagaaaacatttatttttttcgtatctgctgtctgaatattggtattgttttcttcaattgtaatggtaaccggtttgtttggattctgattttcaccgtttactttaaaattaatttcatagaactgataatttccaagcttttctgtttccggaagattttttccgattaacgcttttacatgttcctgagtttcggcatccagttcttttacttccatcacaatgtctgaggttaatgcttcaaatgcaccttccggaagatttgcgataacgcttgtaagcacgtttccgttttcatcctgaaattcatgtctgatttcagttgcttcagactgtacaccttctttagaaacagtttcttcagaaacggtctcttctgcaactgcttctgtttcttttttcacttccggtattgtttctttcgatgtacttagctcttcgttaattccttctgcctgcgtctctcccgttgtcgttgtttctgtactttgtgtttcaggttcctgacttgccatggattcagaagaggttccacctatcagaccaccttctgccatagtagacatgctggttgtcagcatcagaaccatgcaaagcacaaacgccagaatttttttacttttctcacttttcatggcttcctccttctactatctcatcctcgtcttcagttactgcaccatctattaacttcaataattctaaggcactgcgaaaatattgttcctgttttgtttctgcccataatacacttccctgccaggttgagttctgacattcattaatctttacgataaatgttttggtctgttttttcttagccacaatatcttcgcctcctttcttttctcaaattaaatcattaaatattctatgttttttactatgcggttattatagcgtattgcccattacaaaaagcattacaccttatttttttattaaatttttccacaaaaaaacattaccatacatctgctggtaatgttttttctttcgtaccttaaaaacttgaagtattgttgataattttaactaaatccagtgcactggaaaactcataactttcttctgattccattaaaacaatttcgccctgccaggttgcattctgtcgatactgaacgcacaccagaaatgttccctttgtgcctttttgttctaatacagttttaggttcaacaactttaggaattgtttctctttgctgtagagctttttctctcaaaaaagacctgctctttgttgatgcttccggaaaatgaagtttatcatacagtttttccatttcatccaaaagctcaacgacatttttaaaattcgtcgcctcttttttataacaatgataaagacgtcctttcatttcttcctgcgcaatttcgtctacacatatatttacaagattaggtgccgcctttattcgtcctatattttgtccgcttctcatattttcatacaccacacctttacctcttaaccttcaaaggtcattctgcccgttgaaggtaatctttgattttttctgttcaacatccacaatagatgatacataatattctaaatactgtgcccatgttttatgctcacggctgaaatattttgtaattctatcataaatctgaggacaattttcctgttttgtccctaccagtaaaatcaaaaactgattcgggctgtatctggtataagagtcgcctttacgcagtgaacatttaattgtatgatccaactcttcagataacacctttaaacgctctttgttttctaatgggcgtccttttccgtctgttaacgttaccaacatcaaataaacagactgaccatttctttcgataatacgggtcaccagacgataggtatcacggaaacttggcagactacagtaatacgcacctttttcttcatatttttcttttaaaccgccacgaatatcctttaatacctgcggtttgtaactgacccgttcgctcatttctttgaactgctccatcattttttcagatggactgatacccaattctgcaaagaaaaattttgccgtatcttcataaagctgaatggcttctttgtatcgattcatagcaaccagcgcttccatcatcacagactgccattcatcaaatggataaatttcagacgctgatttagaaagttccaacacactttggtactctttctgtgcctttttatactcacatacttctttcagtgctttttcataaacttttttatattctacactttcaagcagtgcccagtcctctcccgaaagttccggaagaaattctcctttataaatccggcaggcttttgtcagcagttccatttttgtccggatatcctctgtctcttctgacttttcaatgagcttttttaattctaaggcatccacctcaacttccatcggactgttccacttatagactccctttttaatttgtatgtaatcatactcaggcagtcctgcatctacaagcatttttttcagtctgtgtgaagttacccttaaattgtttgccatatctgccagttcatctctgctataaagataatctagcaaacgagttctttgaattcctgtttcttttgtatacaatagtatctgaaacagctgcaatgctttcgttgacgttgttctcttaaatgcaatgtctttttctccccagctcacagagaaacgtcctaacatcgtcacctttaaaaccggtaattccttactcatccttatacaccccttttcataggatttctccctgtttgtcaaactacagccactccctaatgccgtacttttgcagccatatcttaaatacaaaatatagttactaaactaagcgagtattcgcacttccctttcctgcttacttgctttcgttaatctctttatacttaagatatcctagcttaattctaactttttgccattcttttgtcaacaaaatagattgtcagattctgtcgaaattggaacaaaaaatcttactctgagtttttttcttaattgtaaactataaatgagcaagttcgtgattttgcatttctcatcattttttgaccacaaatttacgacatttacgacaaatctgacaccactttacaataccagacaacaaagacgcaacccacatttctgtgacttacgcctttctctactcatattttcatcatccagacttttcactctgcttctgataatttactgatggcaacagttcttgcagatggcattactttccacagcactccacaatggctttttccacattttctatctgaaatggttttgccagatgtgcggtcatgccggctgcgagacatttttttgcatcttcctcaaatgcatttgcagtcattgcaatgatcggaattgtttttgcatctgccctctccatagcacgaatcgcctttgttgctgcaataccatccataacaggcatcatgacatccatcaatatggcatcaaaggttcccggaggattattttcgaagcactccactgcctgtctgccattttttgcaactgtaaccttcgcaccgtcatctgtcagcagcatttctacgatttctgcattaagatcattatcctcggctaccagcagatgcagtccacaaatatcatatttctctacaatttcctcatcctttttctgtttctctgcaatctcaaagggaatggtaacgacaaacacagatccaacttcctcctgacttgtcacttcaatacttccattcatctgctcaatcaatcccttagtgatcgccatccccagaccggttccctggtaaacactacgggcatctgttttttcctgtgagaatggatcaaaaatgcgactcaggaactctgcactcatccctatacctgtatcagaaatcgtccatctgtatgtacaaatcccatcatgtacatctgccgcctccattacggtagtaatctttcctcccggccggttatacttaatacagtttccatagatattcaaaaaaatctggcgaagatgcagtgagcttccatagacataaggatagggaatatcctccttatttttctcataaatccactgaatattctcatctgctgccttgtgagtgataacgctctcaatctcatagaccagatctttgagacagatatattcatgagccagaacaatatggccttcctctattttactcatctgccgaacatcattgataagggaaagcaaataatctgctgctatcttcatctttttatgattttcctgtatcagtgccttatcctcaaaatggttctcatcaatctttaacagaccaataataccattcaaaggtgtcctgatatcatggctcatacgactgaggaaattcgtttttgccctgctctcggcacgcatctcattgaatgcagcctgaaggcgcgcctgttcctgttcatcacgttcatgtctctgtgtggtatcctgcagcagaatgatcgcatagatcatagggatctcagcaaggatttctgtatcaaacactaccatactggtcataagcactgttttctgtacccatcggatacttccatcgtcttcgcagacacaatattctacagatatatgtgtttctccgttctcaaacctcttacgaagcttttcacaattatctgtcatgcagtaaccggcaattgtttcctgagtgacttttttctcatattcccagcagtaatcctgataagagtgcggaagcgaataatccataaaaagttcccggctcttctgctcttttccattcagtacgatccttctttccagaacatcctttgtcagatttactgtatagatcacatctgacaattccagaagcgcatccacatagctgtcattttccaagatagactgtttcaactgttcataataaagctgcaactgctcttttgcacctgtctgaccttcagaagtctttcggatagtttcaaatgccaggagaaaatgatgcagctttttatcctcatcccagtccaccggaatcaacgtcagacggttatatgccccctgttttccggtattatactcatattccagcacatcttccttcgtatgcatcttcctttgaagctcagaaatctgcagcccttcgcagatatctacctgacaggaactttcaacatgttcctctatgatctgttccactgctccggaatatgcaccgtcagaagccaggaaaaaattctcgctggaacgaatcgcccgataggtatccatcctggcatcacagtacaggcagtctgagaagttactgccatgctgattaagcagctttaacagctgatatccctgattcctttctgctgtagcctcttcccgtttcacatgatttttattgatatacatgtttttgtctgcgcagttaaacagttctctcattgtactcccgggaaaatcaccggccaatgcaaatcccaccgcataacttaagggtgtatccggatacactctggattcctctgtcatatctctgcgcaccttttcaagacactgtgtcatttgttccctgtccaatccatgggtaactgcaagaaattcatctccacctgctcttcccacaaactgctcagccggcatggaatctcgcagacagatagcaaatctacggatataggcatcaccggcttcatgtcctctgctgtcattaatacgccggagattattaagatcaaaactgcatacaccgatatctgcatccggttcttcctcattcagcaattcttcacatttatttttgttcggaagtcccgtcgcatcatccagatatacctttcgctgcagcaaacggttcattgcagcatattgtattgctttgataaactcatatccgatcaatagcatcaatacaacaatatctgccgtgatatatttttcaagcaatgataaggatgtggcttttttctgcgaatatttttcggccagacctgttgcttcatcacagattacaaagaagtcctcacttctggatataatatctgttttttcatatccttcagaccgccccaaacagatttcgttatacaggtcagaaaagccttcgtccagttcctgcattttattctgaaaatccttatcattcaaatataccagattcagtttggtatttccatcgcgcagaccaccaatgaaagaccttacctcctggatcattgcatcgtcctgttccccggcaacctccagcttgatgatcctctgtgtctctccacgaactaaaccagtataatttacaatacgggccgttccctgaatatcagaaacaattctcatcattataataataaggatagccagaataactgccagaacaccaatactgacctgaataatagtggatttctttttcttattctttacttcagacatgctcctcccccttcttgttctattctgtaaaaaatgacctgaatgaaccgatatcccagatatcctgatatagcgcctgccagagctccgccaagaacatctgtgggataatgcacatatcttttctcccattttttcagcatatgcattattttaccctactttctcctgtatgcctactcaaattttaatgtatttactataaatgagcaagttcgtgattttacataaaaagaaagacaccttaaatcgttcatgttgtataatgaaagtgacgaaacacacattgcaacattcacgaaagaaggtgcctctcgcaaattcttaaaatataaaacaaaaatacacccctgtcttacccttacacaggagcgtattctacatttctatttttttatctcctctgtctcgataataaaccgtacacttccgctctgcccttcgtaaatgcctccaaagttctggtactcggcatctacttttttaagacctcgtatctttgttgtcaaatttgtcaggtcatcacctgcaaggtcggttaatttctgaatggcttctttatcaaactctgcaaatccttcatctaaagctttcatcccatctatcaatgcctgataaccactgtcgagagcacttccggcactgcttaactggtctgttccttcacttaaactctgaccgcccacatatagctgaccgattccatctgaaaatgcactgattccggtgtttaactgactgcttcctttggcaagctgctcggctgcattttgaatcgtctccattccttcctgcaaggtctgcatctgttccggaagtccttcaagcaattccgctgcttttccaagtgcctgcatctgagcctgcatatccgtcaaaatcgcaggaagggcactggtatccacgcttaaatccggaatatcaagcgccggaattgaaagtaagatctgcaccgcctcttccgttttttctctggcttcttttgtcagctcggtatctttatcgttttcctttaactggttttccagactgctctttaatccctcttttaaaatttcctgttcttcttcacttaaagaagtttcctgcatcgtctcattaagagctgcctctactgctgaatctatctgtgcttccctctgcgcctttgcatcattttcaattgcatcccagtcaatcgctcccaatgtattttttacagcctcaacatcgttttgaaccgttgtctgataagtcactgcctctgtcacaaagttttcaaccgtttgaagctgagtctgtaattgggtcagggctgtatttaatttctggtcatctgcaactaatgcgaccattgcattttctactccgctaaaatcaaccccactctgaccggaagcatttccgaatgaaatcgctgacaagctgtttgaaaattggcacaatccgtctgttaatgcctgagctccgcttccaagcgccgtcttgttttcatttaatacctgcattccactctttaagtcatccactccttcttttaaagagtcaactccgcttagatactgcttcatatactcatcatagattttcatcccatctaaaagcttgccactgccgtcttttaattttcctgaagcctcttgaattttatccatgttatcggaagtttcatccaaatcatcgagattctcttcatctaaatcactcagcaatcctgatgaaagcacggtcgctgtaaaatccagttcaaaatccgttacatctgctgtcacttccacatattccggaagctcaatatctttcgtcagctcagaatcggagagattcagattttcggaaagtccggggcaggcatagccaataatcaaattctgtccatccaatgaaataacttttccattttttacttcgatatttgttgcattatcctctgataaaagcagggcagaaatcgctgcaaacggaacaggaagttccactttttttccatttacattcgtctcttctttggtatgattttcataatcaaaacgaatcttaagtgagccgctttttcctgccagctcttttggactgatttctttatcatccagaaaatagctgatttgaactgttaccggaagctgttcactgctctttccttcatattcaatgttttctccctgattgtcccagagaattgttccatccgattgtctggtatattcttcgtccccttttatatttttgatatcggtcagattcgaataatcctgaatcttcttctcatttttattttttaaaactgtatttacggtaatctcatttactgttccgtccgcatctgcctttgcatataccgtttctgttttatctttttctccatcggactgcttctcactgctttgttcttttgtatcattatccttttgagactttgtttccccctgtgtatttccagaggttttatccacattttccttatcggaagagttatccacactgcaggcagtcagtccaagaaccacagccgttccgattccaagagattttttccacaatgcatttcctattttcttttccactttttctcccacctttcactctacatttttcaaggcttcttccatcggaatctttcgcactttccgatattcgatgactgcaactactgcgtaggttaaaattccgattgcaaacatttccggaaacagtgtcggacttacataaaatggaatccatccgctcatacttgtcatcatcatctgataaaaaatgatttccatcaaacttttttccagcggaagcgtgataatcagaagcagtgccgttacaatcgaagttggtataatgtaaagtctcgcaatctctgcattgctgtaacctaaaatttttgccattgaaatcgactgcgcatttttctcaatgacaatcttagaaagcagatagatgacaaccataaagatgacaatcgcaaaaccatccaccatatacatcatgctgcccattgatacagtaagctgtcttgaaatcttcgttaaactttccaaatcaatcacagacgaaatatatttttcatcaatatctgtaatctcactgtctgataaatatccgctgaaataatcatttcccaaatcaaaggttcggttcaattgttcgattggcataaatacgcataaaccgccctcataatcataaattccgcctaccgtaaattcatactgtgtatcttcatagctttctcttaatgttatcacatcgccttttttcactttatacttatcagagtacgctttggaaaccagcacttcgtctccatctgtatcttcaagtggaatgtaacagctgtccgactttactccatagagcataatttcatcggttttatactcactatccaaagtctttaaagaatacgcactaaatttttctgcatcttcattgtccgtctgaacctgatactcaaaatacattaaattcatcaggctttctaatttatgttcttcattcatcgcatttaacggtatatttaaaatatactgataattgcacaacagattcttttcgatttccgtttgataatgatttaagatctgcggaagcatcaacccaaacatcaaaagcaggtttgcaaatagaattccgactgtaagcacaacataattgctgacattctggaaaatcacacgaagccggaatcttgagaaaaatggaatcctggcactcaacggtaatgtatatttttgttttcttttctttaaatcccttcttaaaaatttgagaggggacaacgataatgttctttttaataggaagaaattaatcactgccatcaaaaaaaccggtacaattgtcgtcatcacaaaggcttcaccgttccataatgtcacataagtcggcagactgtagcttccataatacatgcctgcgcagacatttttcagaaccgtataacctaaaatatttccgatcaccgctcccgcaaatgtaaccagcatcggtgcagtcatatagtgaagaatcagttcccgtctggtataacccgaagcccttaatgttccgattactgtagactctttatgtatcgtattactgattgtaattccaaatacaaaagcaagaattgcaattacaatataaagcaggataatcatcatcatacggtcactgcccatatcttcaccggtaaattgaatcgcctgattactgtaacgtggaacaaatgtttcaaggctgacttcactatttaagactttcataaaatcttctgccacatttttttcttccgtctcaccttttggttctgttccatatttccaggaataattacaaatcatgttgtccgtactaaaagaatcaaacgcctcctcagttacaattccgacaccaaattttaccgcatcaaacattgaatcattattgtccgaaaacagacagctataatctgaaagcgccacaagccctgtaattttccactctcttccactttcctcttcggtaatgatatctcctacagacagttcattgttatccgcatacatacggtcaattgcgatttcatctgctgattttggaaattctcctttcatcaggcagacacaattaacttcttcacgatttttaaaaattcgcatcgtacttccatttgtcagcaccggctctgcataaaaattttcatacaatgtcacatctgactttgctatttctttctgctgtgcacggttcactttttcttttaccgtgaaattcccatcttcaatattatatttctcaaaactttcattgtaagcagtcagcatacttccatctgctacaagaaaaccagatacaaatccaataatgctcattaacagaaagaaaataacaaaatatttccctgcctcacctttcagctcacgaaacagcctctttcttaaaggatttttcattttttcctgtcactcccctatttcccatttaccactctaaatcctgggcacttacacgtgcttcattcacataattcttccgaatcattccatctcgcagacgcaccacacgatccgccatatctttgatggcatcgttatgcgttaccatgataattgtattgccatatttttgatttacggtctcaattaattttaagatttcttttgaagttttataatcaagcgcgcctgtcggttcatcacaaagcaaaatatccggatttttaataattgcacgcccaatggcagtacgctgctgctggccacctgaaagctggttcggcagttttttgcggtgttcatacaatcctaatgtacgcagaagttcttccatctcaagcggtttgtcacttaaatacgccccgacctcaatgttttcctgaactgtcaggtttggaattaagttatacatctggaaaatataacccagatgttttcttctgtataatgtcagacgcttttcattcatgtttgacattttttccccatcaatgcagatatctccactgtctgccccgtcgattcccccgatgatatttaataatgtagattttcccgaacccgacggtccaagtaaaacacaaaactctcctctgttgatttccagattaattccctttaagacctcaacaaaactgtccccctgcccaaaggatttttttatatcacgaatctcaagaaacatggtttgttttctctcccttatattagtttatactaaccattgtagcaccagatggttttttcataaataaaaaagaatgttttaaattagtctttgtcactctatattttttctgctataatgtgcgtagacaaaaaattatctattattcttaattttatggagggctttaaaatgacagtatttaatacaaaaggtgtctgttctcgttctattgaaattgaactcgacggtgacactgtaaaatcagtaaaattcaatggcggatgcaatggaaacactcagggtgttgctgctttggtaaaaggaatgaaagtagatgaagcaatctcccgcttaaaaggaattgactgcggtggccgtggcacatcctgccctgaccagcttgctaaagcattagaacaaatgaaaacccagaatgcataaagcatagaaaaagagtggttctgaatccttttttcagaatcactctttttttctaccatctcttttcaactgccggacagtgatttttcttcatcactgcccgcatttccacgaaacacccacagattcgacacattccactcagcagattatcacactccttacattttgcaaggcggttttgatactcctcatcttctacttttaagtctttgtctatctgtgcgatgtactttcgcaaatctgtaaaatattcgttttcatccatatcctgcagaagacattttctacagatttttctatacgatggctctttctctatctgtcccatttgtcacaaagcgaattaatctggtctgccaatcttgcaagatccttatttgctccgccctcattatgccggataactgcaagcagtctgtgaccggcagccacaagtctcgcataaacaccagatgccttgcgtgctttcgctttctcctttgcatgttctattatgataccttcggtctctttctccagcacattattcgccaaatcaaagaccgttccactaaacggagcgtaggtatcatagcccagttcatttttcagccgttctgcaaagagtgtacagacggtatcttctccatgtgtcacaaacacacgctgtggtttttctttaaatgcagatgcccagcgcatcaatccttcattgtctgcatgaccgctgattcccgaaagtcttacaatctctgctgatacatgaatttcttcaccaaacagtcttacatcctttgcaccctccaaaagtgcacgaccaagcgttccaactgcctgatatccaacaaacacaatcgtagaattttcacgccacagattatgttttaaatgatgtttgattcgaccggcatcacacataccacttgcagaaagaatgactttataatgttcatcaaagttaatggcgcgggattcatcacttgtaatcgaaagcttcagccccggaaatgcaatcgggttaattccctgattcaaaagttccattgcctcttcatcatagcagtctacataatgctctttaaaaatattggttgcctgcacagcaagcgggctatcgacatacacatcaaaatccggaaattccggaagcaggttatctgccttaattttacgaagaaaatacagcatttcctgcgttctgccgactgcaaatgaaggaacaacaacatttccatgtcgtttaaaggttcgtcttaagatatcaaccaattcctgcacatagtccggacgttctccatggcttctgtcaccataagtagattccatgaccacataatccgcagactcaaggtattcaggatctttaatcaatggctggtctgtatttccgatatcaccggaaaatacaatcttcttctcaacaccatcttccgtaatccaaatctcaatacttgaagaacctaataaatgtcctgcgtccacaaaacgaactttaattccatctgcaatctgaattattttatgataatcacacggaacaaactgctgaattacattcaaagcatcttccatcgtatacgccggaacaaactccggctgcccatttcttcttgccttacggtttcgccactctgcctcaaaggtctgaatgtgagcactatcacgaagcatgatatcacacaaatcgcaggttgcagcggttgcataaatcggaccgcgaaatcctcttgcataagccagaggaaaatttccggaatggtcaatatgcgcatgcgtcagcaaggcaaaatccacatccgacatcggaaccggcacatcctggttctcatactggtcaggaccctgttccataccacagtctacgagaaatctcttgcccgcagcttctaaaaagtaacagctacctgtaacttcatgagtcgcacctataaatgtcaacttcataaaaaaaccccctttgcggttttaattcaagtactttcaagatagtactattataccgcaaataggggtcttttgatagttttttcagattattttataaaagtttatgattttttcaaaaacagggttttaaacttttttacttaaagatacttaaaaatacaaattgtttttaggataaaaatacttattcttttcattcacagccggcaattcacggactatgaccttatttattggtcattaagataggagattcttgccgagtttaaaattgaataaaaaaattaatcaatccagataccgttggtgataggtacttgagattcagaattacccgatttttgtgctacacacgcagctttcacacgataataataaccaccagctactttcacattgtaactacgagacatagatgctgcattagtagcagtatcaccataagtaccataattcacccagccaccatcatactgctgcaatgtcaatttcacaattaatttatcacaggttttataagcaagagttgctccataaatattgaccgtacgatttccaatatttgtaatttttgcaattccctggtctaatagacttcctcttgcaacattctgccaaatagcttctgctgattcttcattcgttaaaatagaaccatctacttcttttcctaaatcttctaatccatctgctgatactgaaatagaagacacggttaagaatacagataataccaacatagctactattgatttttttaattttctaattactgatttcaaatgaagtctcctttccggattaatatacaatatctttgacgatttttctcatctcttcttctgtaatttttccagaaattcgataatatgaatttttatattcccattgaactaaataggttgaattttcactttcaccgttctgtattttccataattctggttctatatttgacatttcgcactctgcaattcccaagcagactccctcatcatttcgataaagtccactagaatcactataatttgcctgtataataaaatacatataatcaacaccattataatatcttatatatacagactgcgcagtttcatcaatctcataagaatcaaaattcattcgattcggcaaataaaaaaaatgaggaacttccatttgaagtttttcctctatctcacttctagctttctcttctgttctgtcactaatcaatctatcttgactattttctatttctgtatttttctcatcccccaacacttcattcgctttatccataacataactcctgcctccttgtgtgctcatactcacaccaaacaatccaaagcaggttatcacagctgcggcggtcatgccgaggaattttttgcttatgcggtgattaaagaatttaaccacttttgtattctgattttcttttgtgttttcttctgtagatttggtttcatcttcaaggtgttttgtgttttcttcttcgagcagcccctcatcccgagcttcaactaccagcttttgaaacagttcttccggtggctcaaaatcatcgaacctgtcatctgtttccagacgttttaccagctcatctgcttcttttcggaactgttcttctgcccaggtactgctttttgcgctgttttcttcgtttttattcatgaatttcctatcttttcttgacttttcacaacgactgtatcatattatctaatagacgctgcaatgtccgtcttattgaatgttgtacatcgaaacattgatttttgatttatcaggaggttccaatgaaacatattgtgctcaccggtggcggcactgccggacatgttacaccaaatattgctatgattccgagactgaaagaactcggttacaagatttcttacatcggttcttaccagggtatggaaagaaaactgattgaagaaatggggattccttattacggaatctcttctggcaaactacgacgttactttgatgtcaaaaactttactgaccctttcagggttttaaaaggttttcatgaagcgaaaaaactcatgaagcagttgaaacctgatgttgttttttctaagggtggtttcgttaccgttcctgttgttattgctgcaggacgtcgaaaaatccctacttttatccatgaatctgatatgacacctggactggcaaataaactttccattccatttgccactaaagtgtgctgtaatttccctgaaactgtctctgaacttccggccaacaaagccatacttaccggtacccctatccgccaggaattattaagcggaaatccccaaaaagcacttgcctttacaggtctttccagtgagaaaccggtcattatggtcatcggaggaagtctcggtgccgttgcagtcaacaatgcagtacgtgccattctgcctgaacttttaaaagacttccaggtcattcatctttgcggtaaaggtaaactggactcttctttaaccgataccaaaggttatgttcagtacgaatatatcaaagatgagcttgctgacctttttgcactggctgacatcgtcatttccagagcaggggcaaacgcaatctgtgaaatcagtgcactgaaaaaaccaaatctgctgattccgctttccgcacgtgcaagccgtggagaccagattctcaacgcccgctcttttgaaaagcttggttacagcatggtacttgaagaggaggaaattactaaccagaaactgttagaatccatccagactctttatcagaaccgcgattcgtatattcaagcgatggacaaaagcaaacaaacggattctattgaacagattgtccagttatttgaacaggcagtcaacaaataattatttctcctgtgccggcatttggcacaggaattttttttggaaatctatccacaagtattgttctgccggattcactggattctgtttttatatatcctcgtatttgtctccatacgttttttctatccacttgttcatcctatgttttttaactcttaagttttctatagtcagacccagagcggccgccatttctgcatccgttgcctgttcgtaaacctgcatcgtcataatttcgtgccactgagggttcctggcgtacagcctgtccataaattctgtcgtgaattcccgcttgataattgcatcgagcaggtcttctcctgttgttgcctctctatgataaattaacctttctgcgtgttccccttttccattttcacacggctgttcaagaacagtcatctcatgttttcgataactttttttgaggaaatccaacgcctttcttcgagcagttaatgccagccatcccgcatagtcttcaggacttaccttgttccatttctgtatcagcttatggaacacttcctgacagacatcctgcgaatcatcgaaatcttttaagacatcataagcggctttcattaccagtcgataatacttgtcataaacttcacgtaatttttcctctgtcatcttcacctgttaattcatctgaatcttggaaattttttcgaggatttcatttttatcctcttctgtcaatttcccaggagtccatgtcactcctacgtggtcctcattatttcttggaatcagatgaatatgaaaatggaacaccgtctgacctgcggcttctccattgttctgtacaatattatagccgtcacagcctaatacttcagtcattgcggtgatgattttttttgccagaacaattgcttttcctgcaagttcatccggaatttcatatagatttgcatagtgctccttcggtaaaatcagcgcatgacctttacttgccggtcctaaatcaagaataactctgaaatcattatcctcatatatagttgctgacggaatctctcctcctgctatcttacaaaaaatacaatctgacattttaaatctctcccttctagctgtcattgtcgaattttcaaatattttgtagaatgattttatttgctatttgcctataacggtgctacactatcaagaaaaaaagaggaggtaacaccaaatgacaaaatcatctgctacttcacagattgaaggcaaaaataaaacaattgattacaaaaaactttatcaggaacaagcgaaaaaacatcagctgatgctttctcagatttcccacgaaatccgtaatcctgttacacttatcaacagttttcttcagattctggaaaaacagcatcctgatttatcagaagaccaaaactggattaaaatcctggaaaatatggattttctcagaggtctgcttggtgagctttccagttacaataattctctcagactgaaccttgaatcaaccaacgtctatgcattatttgcaaatgtaattgcatccattaatccaagtctggaaaagaaaaacgtttctattgcttttaataaattgtctccaatccctttattgtatgttgaccacaccaaacttcagcaagtgtttcacaatctgcttcgcaatgcatttgaagcggttaaagagggtggtcatatcgtctgttcaattgaatcagacggtacaggtgtgacatttaaggttaccgacgacggatgcggtatttctcctgaataccagaactctatctttgaaccatttgtcacttataaaccggatggcagtggtctgggacttgcaatttcaaagcggattgccgaagcccataagggaagtcttgaattcacctcaagtcctgaaaaaggaactacattcatcctgaagattccgattctgtgaaagcagaatcgttgaaatctttgattattctaagttactctgattattctaattactcttcattctgattagaattttttaagtcctctgccatttttttgtcctctgtaaattaatactgcaaggacaaatccacacaagaatccgccaaaatgtgcggcattgtcaactcctgtgcttgttactccatgatataaagttaaagctgccaaaaataacagcttctttgtcgtaaaattttccagtctgcctttatttctgattactacataaatcaatgcacccactacggcaaaaattgcaccggatgccccggcagacacgacgttttctcctattcgcatctctgacagataagaaatcagactggctcccattcctcctgatatgtaaatgaacaggtatcgtacccttcctaccgcccgttccagacaatctcccagaaagaataaaaccagcatgttgttgcccaggtgcgtcagaccaaaatgcaaaaacatacaggtaaaaaagcgataatattcatgcccctcctgaatcaatggtgtgtatgccgcaccccattgaaccagatgttttccatcaagtgaagaacctgtcaactctgtcaaaaagaacactacaatattaatcaaaataatcattgtattaaccggcacttcttttcttccctttaaaaattgaaggatatcggggtcaattttctgtactatcttttgcttttgcatcttattttccacctttgcaaggtataaatttgctttttttcactctttttatactcctcccctcatttttttcaatcccctcttggtttatgcccattataccatattttccctgttttgtgcgcttttttcatcgccaaaaaacgacacctttcgccatttttttgaaaaggtgtcgtttttataaataatagcttgttttatttttcaagaattttctttaaatcttcttccggtgtgccggtcggtgagatctggaaattttccaccagatagtttaatacgttttcagaaacaaaagacggaagtgtcggtccaaggtaaatattcttgattccaaggtgtaacagtgtcagaaggatgctgactgctttctgttcataccaggataataccagtgtcaacggcagttcattgacaccacattcaaatgcttccgcaagagccagtgccactttaactgcgccaaatgcatcgttgcactgtcccatatccataattcttggaaggccttcgattgttccaaggtctaagtcattaaagcggtattttccgcaggcaagagtcagaataatagaatcttttggagcttcttttacgaaatccgtataataatttcttccctgacgtgcaccgtcacatccgcctactaagaagaaatggctgatttttccggcttttacagcctcaatcacctgtggagcagcacctaaaattgtatgatgtccaaatccggttgtcagttttgttccaccattgattccggcaaactgcttatcctcagaaaatccaccaagttcaatcgctttttcaatcactgcgccaaaatctttttcttctccatctacatgctgcatgcctggataggctaccacacctgttgtaaatacacggtctgcataactttcttttggcggcataatacagtttgtggtaaataaaatcggtgccggaagattagcaaattctttctgctgattctgccatgctgttccaaaattaccttttaaatggctgtatttgcgaagttccggatacgcatgtgccggaagcatttctccatgtgtatagatgttaatgcctttgccttcggtctgttctaagagcatctttaaatcttttaaatcatgaccggaaattacgataaatggtcctttttctacttttaaagaaacttctgccggtgccggaattccataagtttcggtgtttgctttatccaaaagttccatgcatttaaaattcactgcaccggtctccattacgataccaagcagattttccatggtgcggtcctgtcctaaagctgacatacctttgtagaagaaacggttcacttcttcatcattatagccaagcaccattgcatgataagcataagccgcaatcccacgaagtccgaataataataatgatttcaaggatttgatatcctcatccggctctctccatactttttccatttcatagatttccatgcgtccacatggagcctgacaagctgaacatcctgatgcgtaaacctctttttctttcagggctgtttcgattaatttttccaacgcttcatcatcaaagtttacattggtaagagttgcaaacaatccttcaatcataatacgatttgtcttttcagatacattctgttctccgactgcttctgcaagcgcaaccagacttccggttaatttgtcctgaaggagtgccgttttactgctctttccacagactcctcttgctcctgtacatccactgcatcctgctctctgctcacactggtagcagaacatttcttctgttttttctattttgctcatcttctattctcctttagctgtttcacttattttttcaaatttcttgtttctatggttagaatatactataattaaaataattattctgttgtacttccaacaaattcaaggagtttatttatggaaaaaaataataatttaaatgaagcttttttagaagtgcttgcggagtctccattgtttcgtgaaatcgaaaagaaagaacttcgtgccatgttagtctgtcttggcggtcagataaaagaatataaaaaagggacttctatcttccgctggggcgataaaatctcaaaaatcggatttgttttaaagggaaatgttcacgtgcttcgggaaacgtactggggaaaggaatctctgcttggacggattggtcctggtgatttgtttggagaagtctatgcctgtctgccggatttggaatttgacggaacagttgtcgcccagactgactgcagtattttatttcttaatttaaaccgcacgattgctacctgttcctccgcctgccattttcacacgcagatgatttctaatctgttgcagattcttgcacagaaaaacattgcattttcaagaaaactcgactgcctgagccaccataccatccgtgcacgacttattgaatatttctcaaaacaggcacagatttgcggaaattcttctttttcgattccattaaaccggcaacagcttgcagattacttgtgcgtagaccgcagtgccatgactgtagaattgtataagctaaaagatgagggaattttggattttgacagaaataaatttacacttttagaataaaaaaaggaaccttgtcactaagattcctttttttaaacagtttttcaatttcaattctatttttaagctattgctgttttactttctttttttggtttgtaaagcggacattcgcaatccgcttcgctacttgctcatgaacgcagtcgcttcgcgatctgtcagtgggagctttcaactctcactgacagaagcatccccctcacccaccgcttagcgctctgcacacttgaagcgggggaatgcttatctgcgttcaagtaatttcttgataccctgaattgctactaatacaccaaggattaacagcagaactgcgaagataagctgtaagctgtttccaaggtctaagcctgttgtcataaatgctttgcttaattttacgatagtcatgccaagtgctgtaaatgtaacagccatcataaataccatcggtccccaaagcatgaagccctgacgttttgttttctttaagaatactgcgcaggctaccagtgccagtacggataacagctggtttgctgaaccaaacaacggccagatttctgcatatcctacttttgtcagaaggtaggcaagtaccagtgtaatgatagttgcaaaatatttgtttgtcacaaattttaagaatggactcatattctcttcatctacatcggcatcaaggaagaattcctggaaggacagacgaccaactctggctacagagtccagtgaagttaatgcaaatgcagatactgccaggttaatcaaagtaaataccaaggagtgtggcagaccgattacggaaaggaagtttgcgattgcacctgcgaaaatctgaggctgagttgtcagtccctgtgctgctgcttctccttttgcaaaagatgcaactgcgattaaggcgataactgcaagcatactttccattaacattgctccgaaggataccggaagcatatttttttcatttttaatctgtttggaagcagtaccggaagagaccagtgaatggaaaccggaaaccgcaccacaggcaattgttacaaataagattgggaacatgtactgtccgtctacgttaaagcttgtaaatgctgcaagattgcaggatggatttgctacgaacacaccaacaaccgcaccgacaatcatgaagattaacaggtagctgtttaagtaatctcgtggctgaagcagtgcccataccggagcaacactggcaatcatgatatatacaaagatgatgatgtgccatgttccaaggcttaagtacatcgggaagtttaatcccagtgcaattgctactactaataataagacagccaccgctgtattcacccatttgttaaatcttgtgtattttaagaacattccaagtccaacggcttctaagataaacaacatagaagtggttgcaactgcaccgttagctactacttttgttacttctccggcttcgtttgctgcaaatccgttaaatgttccggctacaacatcggcaaatgccgcaacaaccagaatacagaataaccagcagaataacaggaataactttttacctaattttccaatatattcttcgatgatataaccaattgtacgacctttattttttacagatgcgtacatggatgcaaaatcctgaacagctccaaagaatacaccaccaattaaaatccaaagcagcaccggaagccatccaaagattgctgcctgaatcggtccattgattggacctgcacctgcgatagatgcgaactgatgtccaaatactacgtttgtgtccgccggcacatagtcaactccatcttccatttcataagcaggagtttttgcgtttgggtcgatgccccatttgttttgaagataacggccatacaggagatatgcacctccgagtactacaatggcgattaccatcattaagattccactcatagctctttccctcttctcttaaatttattttttaccaagttttgaaaatagaaataaatttatctataaaaaaacgcccttgctatcctctcggataacaaaggcggaattttctttccgtggtaccactttgtattattgtacctatcgctaactacaatctcttaccactgtcttttttaacagtctcttctgtaacgtgaagcccacgtccctgcctactttcaaagttttcaaagcttttcaatacgtttaatctctcaaagctttcatttcagcgggatgctctagggtgatgtcacaaaacactttctaccgtttcacacctgccaacggctctctggattccagttctcttttgtgatgtatccctttcactgcatttccttttcttaatttatgttatgttttactctttttttatttaaaacacaagagtatttttcaacatattttatagtttcgtcgatttatttttgtgcaattttcagataacaccttttattttctccaatttggcaatttgatagctgttttgggatttaattccagtcatcttgttcttctgcttcctgcactttttttaatttttcttctttttgttttttattattatgactgtttcggattacaaacacaacaaccacaatcaagataagcgcagccagcgcaattaaaatttctgacaactgtcccattttagaatcagacggttccgacacgcttattgctgtctccggtgcatcacttaaatcaaacagggtattttctccctgctgatatcttttataactttcaagcgcataaagcgtctgatatcctgccaatgcatccggcgcattttcattttcttccagagaatgagccattcctccatcctctgtccgaaattgtaaaattccgtctaacaggctgttttcttcttttaagaaacgagcatcttctaatggattgatgccattactacacacggcaatcaacgtccagtctgtactttctacactttctacacccatagatggcattgctccatctgcctgctgctgactggaaagccaggaaaatccattttcaattgccgtactcactttttcctcatctttatacggagccagtgctgtgagtgccattgctgtgatatccacatcggaatctccatctgtggaaagtgaaaatcctccatcttcctgctctttttccagaatcgcatccactaatttttcacgattccagacagcatcttccggttcttcataatctttactgtctaatgcaagcagtgcccagatataaccatttgcaccctgtactccaggatcttgattttcaaacacacagtcaaaaatcccatcttctaccagattgatttcttttttatctttatctgtgccaaaagcaagggcatctcccccacaggcatttattgtcaaaatttcccggtaaaaatctgtcggattcatgtgctgttcttccactgtttttgtaatatcatcttcatacagtgtttctatctgttcctgcagtgcactaagataaccattttgattatccggctgtttcattctgctgactgtaaatgcaagccagtctcctgctgaagttcccgcactctccagtactacgccatccagaagatttttcccatcaattcccatctggtctttttcccaggaaacaattccatcctgaatggacttaatttcatccacctgatacttctcgctgtctgcctgtaccggtactgcccctcctacaaacagcactcctgtcataagcagagtaaacattgattttttcataaataagttcctctttttattttacacatactatttatcaatacttcaataaaattttctttcgtttctttgagccaattaccatgaatccaatacctgcaagcaccagaatcacaagtacaccaagcaccgcacataaaatctttactaccctgtaattttgtgctaccggtgcactgccttttgccgtgttttcttctccattctgcatgcttacaccggcatctccttcttctcctgacaaaagtgcagtttcattttctgccgaagtttcttctccatccgcattttctgcttcctctgccttcgcctcttgattctcttttgcagtctcctcgattttcttttcctgtgcctgttctccgttcttagcattacctgatttttctgctgcatttcctgatccagttgcattagagcttccattttgtttcgcatatccactctcatgcgcacctgcatgggaattagctgtttctcctgctgccgcagtattttttatctggctggtttcatcactcttgtttaagccctgataagcggattctgccttttccaaatcgctataattttccaccagtgatttttgtctatcacttaaactattgtaagcatttcgaatttgctcaagcagagaaccactctcttttgtcaccactccgatttgagaaatctttgtgctgacctgatgcgccgctaataaatcagaatagttctgataagcctcttccaacactgaataattgctgactaattcctgctgttctgcggtgagtgcattatacgcttcgattgcacgggtaatcgcgccgcctttttcaagcgtcacttctccgatatttttaattaattcgatgaccggactcgctaaaatcaggttctgatacatcgcttttgcattttgaagctgcttatagtttgtcactaatttcttctgattgtccgttaaggcatcgtataactgctgtgccttatagatggcatctttactgtttaaggtaattgttccggtcaaaatcgcggagatttcagcggaaacttcctgtgcctttaacttatcataagtctgttccgcacgattcagatattcgggatgtgccacaaggctctgctgtttttttgtgagcgtatcataagcttttcttgcctgtaaaatcgcatcttttttgtctattgtcacaggttcaagtttatttatcagctcatccactgctgatgctgcctttttatcagcttcatccacttcactttcttctaacaggcgggcatattctttttcggctgattctaacacatcataattgctgacctttgcttttaattcgtctgataattcgtcataagcacttcttgcaagattaatgtaagtcttactctctaaattgaccgttcctatctgattaatataagcttctaccgcagaaattttctcctgattttctttctgggttttctgctcatctgtctcaagacggtcaattctggatttcacatcggcaagtatctgatttactttttcaacactgtctgcctgatgcagatatttcactccatcggaaacataagtttcaagctgaattttttccgcttcacgatatgcagtttcatccgcataattctgcaattcttcaattgccgatgcaatggctgattctaactgtttttgttcggcttcttttaaggtttcgatttcataaatcttctgcttactgtctgtcagaatttcattcatttcatccatactctttgcagactgtaatttttcgacgccttctgctatcagagccgatacctgtacccagttttcttctgtatattcctctgcttttacaaaagtctgtaaatctttgactgcccctgcacggaactcttcgagatttaattcccattttaaaatcggaaatccatcctgtgtgttcatataatctttgataaaatgatttcccgatgcaagcagtgcatttaagaaactctctgttttcatcttatccgcttccagatattccccggtacttgcacttccgtttaataaaccaactaacggaagggaggcatttgccggatttttgagcgccgtcagattcgtataggttccatctaacattgctccaaagagtgccccgatacattttccactgatattcaggttcacatctccaatgttatagcaacaggaaatctgtgaaccgcctgaggcaccggtcataacaccaatcagaccgcctgcataagaatttgccagtacatctccggtattatagttggatgtcactgcaccattacttccactcatacgtccaaccagtccgcctgcacaaaactctgcttcaacactgccacggttgacgctctggcgaacacttacagaatttgccatatctccaataattcctccggcatagaactggattcctccggcactttccagactgacatttcctttatttgagcactggttcacccacatcttatctgcataaccgacaattcctccgactgctgaacgttgacgttttgcatttttcacctgaatctgcacttcactgtgacagtttcggatataatttcgctgactctcattttttccatgcatgtatgccacaattccaccggcataagcaattttttcgctacattcaatacttccctttacgataagattttcaatgctttgcttttcgtcgccatatacgataccaaacagaccagagtatgtgtcaccgctttcgattctaagcccacgcacaacatgatcctgtccatcaaaacttccggtgtatggaatcttagaactgcttccgattggtgtccagttgtgatttccaagattaatgtcatcgcacaattttgcatttgctttcgcccctgttacgccggaattcaccagttgtacaaaccacgcaagttctgcaccgtttgaaatctgatagtatccttctacaagttccggttcttttgtgctctttccgtcccatgcaccttcctgcggaatattatttaaaatctcatcgatttgtttctttgcctcagcaagggcagaagcgacttctttgctggttttcgctgactgaatctgtttttctccgtctgcttttgccgtttcgattttatttttccaggtttcctcaaccgtaacatccgaagcataatttttcagttcttcgattgcagacgctttgatttctcctaactttgcactttcggtatactcgatggacaattcattcaaacggtctttcgcagtttttaataacgcttcgacgtcggcaatggtcagggcattttcgatttcatcttcaaattgttcttctgtctgttttagctcggcaatctgttcctcactccatttttcactgccctgtaagagttcttcctgatactgtgcaagctctaagattgcattatttcttgcctctaacaatttggaatcgacttccgaaccaggtttgattttttgaagggcttctcttgcctctttcatgacgctgtccaaatcatcctgagtcacaaccgaatcaattttctctaaataattttccactgtctgttcgattaaaatataagttgttccatatttcttcttattttcctcgctttgccagccctgtaattcttcaattgcagaatcaattttgctctttaaatccgtcgtctgttcctcaaaagccagtttaggatacccgcctcccgcatcaaaaatacttgctttaataaaagcagaaccaagtttcgttatcattttctggcttttcattgttttttcgatataaagacccgtctcgtcaataatttctgtcgttttatcttctttaaaagagtataaatccagattgtaggaagaatcagctcgaagtgcatacacgcgtccgatttttccacttttaaaaataccgataattgcgcctctgtattcaaaggttttattcgtatagactgcaatgttataggcatttttaatgactggctgtgccggattctcttcttctttggtatcggcataacccagtttaccgacgattcctccgacaatcgttcccgtataggaaaccaatcctccaagttctccctgattgtaaacattttgaatcagacattcttttaccgttccatctgcatagacactgctttcattgacaccaccggcaattcctccaatcgtatccactccgctgatttttgctttattgtaacaattctgcaccgccgcgccctgatagactcctccggcaattcctccaaccgaataatacccctgcactgcttctttattttcgcaataacgaatgactgcatttggtccgacttccattccggcaattccaccgatgttatgctgcgcaaatcttaccttggtagaaagcgttccattattgacacaacgtctgactgtcccggaacagattccgacaattccacctgcattacgacgaagggcttctcctgccatcgtggtttccgtatagttggtacagccggatatggttccgctttttaaataaccggcaattcctccgcttccgatatagagtttttcatactttccctcggtcttataagccgcataattattatgaacttctccggatacttttacattggaaatggttccaccatcaacaacaccaaataatccggcataacgcacgtctggattttcttctgaaatctcggcatctaaaaagtataccgtatatccatttccgttaaatgttcctttataggcatgttcggcagtatcgccaatcatcagccatttattttgagacgttccatcacccagataaattttatccgtcagttctccgtttatcgaacttgcgccgtcatttactttctttgcaaaccacgcaagctctgctccgtttgaaatctgatacgttccattttcatcggtttttggaacttcggttgtctctccatcccaggcattcataatttttgccgcctgtacttctctttgtcccatgacaggaaccagagtcatactaactgccagggcaagcacccatgccagcagtttctttccataacttttctttttcattttgattccaccttacaggaaataaataaatttcaactggaatcgttccagccatcctgcttctttgtaaactttttcccagaccttattcttaaattccataacaaaatctctctgttcttttgctatgctgtggctgctgtaaacggcttcctgtctgatatctaccaccttggtatattctattttcatttcttcatcaaacaagctttctatctgacttccataacgatacaaggaagcatttcgcactttcaaaccaaagactgctaaaatattcatggtatattcaaacaatgcattgactgcctgattataatcttcactgtcaaataattgttttatcttctgacagcgaatccgctcacggatgatttttacaataattaaaatcaaaaacaaggtaatcagtacaatcaagataccaagaagcatttccagtatcaaaatccagtcaatctcatcttcctcttcttccggttgttcttcgtcctcaagattatcctgttcatcctgttgttcctgctcgtcatctgctccgatacccgaagtaattcccgagatatcctgatactcttctgcggtctccataattccaagataggaaggagtcgattcaaatggaagccagccaactccatcctgataatattccacccatgcatgtgcatgcgttccatctacggtataaggctctccggctttcatacttttgacatcgtccggtgtaatcacatacccctcgacatatcttgccggaattttataataccggaacatcaatgctgccgctgtcgcataatgcacggaataaccttttttggtattttcaagaaaattcgttaaaaaatccaaatctccggtttcttttttgatttcttcactgtaagtacagcgggaactcaacacatataaaatattctgtttcgcctttgtataatcaaaatgagtactgccatttgcaagggtatactctccaagtacctcttttaattctgtctcaacagactctgggagttccaaattggtctcatagacatattgattataaaatgcttctttttcactgtacgcttttccctcttcatccagattttctgtatctgcaagttttgcggtaagagacggatattttttaatctgattttccaacgccgtataagtatattttcgctgtccctttaagccttttgcaataacaccttcatctccgattcgatttttatcaggcgttgttccggtaagttcataaggtgtgtacagataacggctgtcctcttttaagttttttatggtgacagtattttccggttcttcttttgtcgtctcatctaaagctaaagatgcaagcggtaaggtttcctgtccgaaaaatctatcctgatgcagccagtaaaataaatccgaagcgttataaagtacttttttatcggttgtttcccaaccatgtttattgtaaacactgccggtgtatcctcttaaataataagactgtgggtcgctcattgtcacttcaagcaccgcatcatcttttaatttcaaagaagaaagtccttcaaaatctccttttggcatcgcatcataacttccaccataccgccagtcttctattttttcttttatcgaagcttctaacttgctgactgtttcatttttggagtattctttttcgggcacaagcagcatgaaaataagtgttacaaacaaaatcatacctgctgtaaaacaggcactttctatttttaaggcactttctttgcttccggtttcctcttttcgatgcatccgaaaccatatcaataacaatgcacctgaaaatacaacattgaaaacaaacgatggaccaaatccgagcacaatctgtaaggttatccacataagtccaatcagaccggttatccaccggttttccatcttgataaatacggtacttatcttttcgataaccacaaccaataccgccatcgtaaccgaaagtttccacttgtctgacagatctccacctgataccggatactgcggataaatataaggaatgtgctgtttgatttcatctaaaatctggtttaaaaacagattccatccatccagtatcattttatgaaagaggagaagcaccagtatcagcaccaaaacttctgcaagcagtgcatattttttcagttttcctttccactcagcttcaaaagaaagatacaccgcaaacacaactcctgcaatggcaggcagtgcatttacctttattccaaacatgttgcagacggcgatgcctgtcagcattgcaaatatccataccagcagtccgtctatgaaattttctattcttttttgtttttgatttttttctgtctgtacagcaacaagcagaattcctgtactgtttttttgattttttttcatgaatcgaaccacctataattttttctcttgcttgcggaattttccacctatatttcaagatatgagagttccgcttcggcattttctgtcgatacggaaatcacatgcgccccttcctctgtaaattcgcctctcggctctttctcacaaatcacttccgtcaccagacaccgttctgccaaagccgaggcatctgccgtcagatatggagtgaatagcaccagatgtgcaaactcacattgttctctctgttccatgtaatgaccgagaaccgaagttccatcttctcccggaaccgctgaaagaagttccggaagtatcattgtaaattcttccagactgtcaatttccgcactgctgtaagtctgctctttatggttataccagccaatactatgtacaatctgctgttcgcacatttcctgtgaaaccgataccagacattctaccagcttttccatctgcgatggaaattcttcgcttttttccggatatccggtctctagtaaaagtaaaatggtattctgcaccgggagtccataatctcttacgattaatccatctaatttttctgaaagtttccaatgtatctgatgaatgtggtcacctgcacgatattctctgactgcaaatgtttcacttgggtcaaatccggctttgctcatggaatattcttcggcatctagcactgcattttccccataaaccacttccacctgaagtccaaaagtattcggagtaatcaatgtcattttttcagaatctgctagaatttttgtttttctaagtccaaaataatccattaccaaaaatccttctaagcccagacaaagttttccgcagtgcctgctttttaattgtaactgctgaagtgtttctgtttttgcgggagcagaagctaaaatctcatactcttctgcctctcctgtcagcatgttttcgcattttatctttgcaattattctgtcaaaggggaacaaacctgtattcttaatctttaacatggctgtcatgtctttttgtttttcacccagattgtctatgcctaaagttccgaaaagtttttttgcacaaatctctgcccctatcatctcaacaatcggaagcaccaatgaaattgccaacagccacagccctgcataactatctgtaaatacataaaacatcacgcataaaatcagttcgagtccccatagaatccttgattttgccatagtctctcctatcgaccattatccggcgattttgtctgttttaaaacttctattaaaacatccgaagccgaaagtgctgcaatttttgcctttggatttaaaataatacgatgcgcacagacgtccaaaaagactttctgcacatcttccggggtgacataatctcttccctgtacgtaagctcttgccttggcaagtctggtcaccgcaagtgcccctcgaggactgactcctaaacgaatcatctcctgttctctggtattcattgccagagaggtaacatattctaaaattttatcttcaatgtaaatctgtgtgacttcatcctgcatttctaagatttcatcggttgatgtcacctgctctgccttatcgagtggattctctgtctgacggtcacgcaggatattgacctgactttgaaaatccggatatcccatttccatacgaatcataaaacggtccaattgtgcctgtggcagcaactgagttcctgcagaaccaaccggattctgggttgcaagtaccacaaacggttttggcaattcatgcgtctctccatctactgtcacctgtccttcctccataacttccagaagcgcagactgcgtcttactggaagtacggttaatttcatccgcaagcaaaagatttgtcataaccacacctggcttatattcaaatgttccactttctttattatacattgaaaagccaatgatgtcggacggcacaacatctggtgtaaactgaattcgatgataatccagacctaatactttagagcatgcaagtgccagcgtggtctttcccaccccaggtacgtcatctaacaaaatatgaccccttgataaaattgccatcaatgtcttttccagcaccgcttcttttcccacgatgattttatttaattctttcagaatttcttctgtttttgtattcatctattcctgcctctcttttcctgattctttatttttctgtttcttttaccattctttgccataattaccctgaacatttccgtatacaccttcatttccatactgaccgatatcctttcctcctgccagggtgtaacggacacgaatttcatctccgtcagaaagatttctgcttgccattcctgttccgacgtaataattattgacgcagaccatccagcctgaccattgtgcaaaatctttttcccataaggcatcggtctgatagcttccggtccagcccattccatcctcaataatcatctgtttcaattcatccggtacacgaagaccatttgtcattcccggctttttgattccggcaagataataactgttgtccacacttcctgtaatcatagaagtaaaactatattcagcaagctgttgttcgactagctgtgccagcgtggtgtttccatctattgttacttcatgacgtggaatcaacattccaagaccgactgttccggcttctaactggaaggtaacggtaatctgggacggattataaagtaccgtataggtcttcgtcgtctcatactgctgattatcttttacagaaatgacaacttcattttctccctgctgaagatgcaggagatattcataagcagttccggaacaaccacgatattttacttcttctccattgacgtaaatgtgcatgttgtctgcacttaatgcgccaccgccaccactgacttcttttgcagaaacattcaaatccacatattcggtgttgtattctgattttaaattatgttccacaaccggtgccatattggatggtgtctcaccggttcggttaaattcgatattccaggtataactgcccgaatttccattggaatcaataaatccaactgcaattggcatctccctgtctgcatacagagaaattgtataccagccatttgaattggcagacggcgagtatgttccacctctgctgtctccgcagaccacacttgtaatttcttcttttccggtaatctgactgtgattgaaacggaaacgaaaactatttgtattattttcatatcgaaacgtctgagaacctccgctcatctgcggggtaatcgtactcgaatttttttcaccctcaagcgtcaaagtaaaatcgtccgcctgtttttgagaatcatagtaaattgtataattctctgataccgttgctgttccggttcccgcaattaatgtaaatacattctttccttcacttaaagtttctgtataagcggtatctccatcggtcgattttagggctttttcactatttcttcggatgattaattttacccgctctgttccttttaaggcataagcggtaaaatcaagctgttgttcctgcaccgtctgtccatctaatgcttttaactcatcggcaataatcaaaatctgattggatggattgtaataaatcgtataggttggagaagagactcggatattgctccatttatcacgaaatgtcacataaactgtaactttattttcaccttcagaaagagtaatgcttccgttataattctgctgattcccatttatgtcaactaccgtactaatcacagaaagtttggaatgatacgtaattgaaaatggatattctgcttccgttacaacttcgtttttcaaacttgtcgtaaaatacgcttcagaattttccggtgctaccacaatctgttttccatctttctggctgtccccgtcgccgtctccttttccgttgccattgccaccggttccctgaccactatttccggaatttccatttcctccattttgactgtcaccgccggatggtcctgtaccggaattattttttgttttatctttttttacaattggaagcaagctgtcaagttgttccgaattactgtcaagaggagtctgtgaaacctgctgctgttcctcagaagtttgctgttcctgtgtttctgtagaattatccgaattctcttcttgattttcttcctgctgttgttcttcttgctgctcctcgtcctgattttcttcgtcttgttcttcttgttgctcctcttcctgttcttcttgattctcttgatttcccgtattgatattggcattctccacactgtccagaagtgactcatccatggccagactggaggaggtcacatacatacgggatgggtctgcattttctttttccataggattttccggtgctgcctgattctgtgtcacagatacgacaaaaagcagcagaaccaaaatcactgctgctacggtcataaatgatttttttatttttttccagaaattccgtaaattcatatcttctacctactctttttatatagagaagaacagacccctgtcgccagggtctgctcttcctttgttttattactgtttattactgtactgtttttttgtaacacattgattttctatcaaatgttagcctgtccgtacactaattatctgcttcttgtgcgtacaccggatgcatttacatagtagtttccaatccatgtattggttttcatagcaccatcattggctccgccaaagtagtaccagtttccgccaatcttctgccatccggttttcataacaccatcatttgctccaccgaagtaatatttctttccgtagatggtctgccagccggtcttcattgctccatcattggaatgacccagccagtaatattttccataaactttctgccagccggttctcattgctccgtcgcttccaagccagtaatacttgttgtaaactttctgccagtgtgttttcataacgccgtccgttccaaaccagtagtatttaccatctactgactgccagtaagtcttcattgcgccatcgtttccaagataatatttcttgccatcgatcgtctgccagcctgtcttcattgctccgtcgcttgcatttccaagatagtatttcttgccatcaacggtctgccagcctgtcttcatcgctccatcattggcatttccaagatagtatttcttgccgtaaacagtctgccaaccggttctcattgctccgtcgcttccaagccagtaatacttgttataaactttctgccagtatgtcttcatgattccgtcagttccaaaccagtagtaatttccatctactttataccagtaagttgcctgtgtaccatcttctttgtagtaatatttcttaccgtcgatggtctgccagcctgttttaacaaccagtccatctattgctgactgaagtttttcagtcatttcggcaacctgttctttggattctggattttctgctaccgcttctgcttctgcaatcacatcctgtaatgcattgtaagattcatctgtgtatttggaagcatctgttgcttttgccgtttcaattaaatcctgaagtttgtctgtatcaattgcggaatttccaactgcaatcatgtacgcagagtcattcttgaagtaaatggtgccatctttgtctaccgctacgctggagatgcagtattgtttgtgttccggtgtatacagaacctgacttccttcatctggttctgtcatgccaggagcatcttttacaacccagaggtttccgcttggtccgtttgttgcaaagtatacatagttatatcctttgtaacctgttgatacaacacctgaagtctgaggataagcatctgtgtatactacatattcaagattcattgcacctgtttctgcattaatatctacaactgagattccataagttccactgaaatttgaaccgtaagaagaacctacataacagcgaccatttgcgattgccggagtacttgtgctcatttttccgatttcgattggctcaatcagattttctgtatcaattgttccgtcttctttcaggttataggaatacagatatccaccttttgatgtaaaataaattcttccgtcataataggagatatctgaacggatatcgccatgatgcggaccgactttctgaactacttcaccagtcagcttatcaaagcaatatacataagaagaatcacttgttgaatcggattctccatcatcgcttcctacgattgcgtatttatcagttacataagcacctgcccaatagaatccaccctgtacggcataagtccaggttgcatattttgtttctgtcggattatctgggtcttcatctgttgcagaaacacatacgaagtttgcatcttttgtttcactgttccagaatcctgtataaatatatccatcagaatactgaatcgtacagtttggctgtcctccaagtgtatctttaaatacccataaggattccagagtttctgcattaaatgcctgtactgctccacctgcaagtcctacaaaaatcattccaccaccgtagcatggagggttgattccaaaactactgtttcctgccatcggtgcacttgcaatgatatcaccagtttctttattaattttaagaagctgttttcctgcatagcagtaaagattgttgtctacgataatcggagagctgactgcccagttgctgaacccttctccgactttcttttcccatttctggaatgctgtttccggtgtggctgctgtctttgcacttgttacagcctgattacttccatcttttctaaatccagcccagtcacagtctaaatcttttaagttgctgctctgcgctttttccagagaagctttgataacagtgtctttctctactgtaatctcttcatgttttgttacataaccggtcttagataccgtataggtataagttcccggaagaactttataaatgccgtcttctccgcctgctttgattttatctttgtcaataactgtgataattgcatctttcggttctgtttcaaaagtaatcgtaacaggttcttctcttaagatagaaactgtatatttgcccgcaacagtattttcatttcctacctcaatttctgtaactacttttgcatcgtctccggttaaggcaagtgtgtattcaccgttttctgctgtctttccgtttactttaatttcagaattggcagcggttcttgcagttgctttaaatactacgctttctaatgtcttaggaacaacaatcgtatattctttttttcttgcattgaaaaccggatctaatgtcacttttgttccatctgcttttgtgacacttaaaccggaaagggtcgtctcacgaataatatgaactttataagtttctgttttaccggtttttgaagctacatcaattgacatttctcttgcttcaatgtcagactgaagcacacgatttacaccgctaaactgtgtaaattcatttgccggcatagcttttgttaaatcttttgtatagttatagtttttgtagtttgcagtaattgtattaacttctgcatcatcacttaaaaccggttttaaataaaatgtatttaccgtttccggtactgcaacggtacattcttttgtctttgcatctaattcagactgcatcgcataaacattttcaccgtttttatcggatgcaaatacaaactcttttaccataggctgtgcagcacttactgttacttcacaacttgctttgaatgttcctgctgttacagtaattgtagcacttcctgctccaactgcttttacagttgcgctcttgccttcacctgttacggttgctacatttttatcatcagattcccatttaacatctaaatcttctgttgcatttgcaggttcaaatgttacatttaatttgctttctgcatcttcctttaaactcaggctttctttgtccagagcaatttttgtcactgcaatctgttctactgttactttgcactctgcactgactactgtacctttattattggtaaaggaagccttgattacagtagtacctggagtttttgctgtaatttcgccattctgtgcgtttatatcagcaactcctttatcagaagattcccatgttaaagccggtgccgtttcacctttttccagttccggtgtataagccggtgtcagagtttttaccgcacccggagccatggaaatttcagttccctccgcaaaggaaagatctgttacggttgtaccgtttgaagtaacttttacatcgcaggctgcttcaacggtgtctcctaaggtattaaccatagaagctttaacggtagttgttcctgctgattttggagttacgactgcacctgtttcagatgctgtaaccgttgcaacatcctgattactggaagtccagtttaatgcctttgatacggttgtctgagccggtgctgtaaaacttgtcagtaaatcgatatccgaaccaacttctgtttcgatttctgttaatgcagcatctggctgttcctctgttgaaaaacgaagtcctgttacagcatccgtatcatagttaagctgggtattccaggaatcatctgtggtcagacgacagtcatttgtcggattgtctgaccagtaataaatcagacggcatccatcctgaagctgggcagctccatcataactactccatccattggaattaaaagagccatctgcgtactgaacgataacagaccagtatcctttactccagtcactctgtaagtcaactccgtccttatttttcatatcatctgggaagcagctgccttcatctgaaaaatgatagtcaatctttgcttcttttaatgcagccttaatctggtctttacagttttcagccacataataactttccagactgtttacatcaatattaagcggctggtcttttaaccaatacacatatccggtatgttcatccagatttttactgtgatttccggtatcgccgattacagttaaggtaatgcctgtatttgtatctgcttttgcaacaaccggataccaacccgttgcaacagttgatacaatcattaacatcgccatcagcattgccagaaatcgattgttctttctctgtttcattttgtttcctccttctttttatgcgctttgagagtgcattatttcttttgcgttatataaaaaaagaccttcccatcaggaaaggtcttcatttatccttgtgtctactgtgttataatgaaatagttcataactatccgcagtatttttcactctatgtattctactgcaaattcaaactttttacagtatgcttctactttgctgtcttttctgcaccgtatcaccgtacttttgtttacaatccagtctccgataaattccggttcatgagcaatctcaactactttcagacgatgacatccatgaaatgcccattttcctatccgcttcacactttctggaattttcacggattccagattgttacattttaaaaatgcactgtctccaatctcacgcagtccatccggaagttccagttcttttaatgctgtttgataaaatgcctgagaaccaatcttccgaagtgccaatggaaattctaccttttcaagatttaaacatttataaaaggcacgacttttaatttcctggacagactttggaatcttaatttccttcagactttcacatccataaaatacctcttccgcaagatacacacacgttacactttcaggaaaagttgctgtttccagtttcttacaccgaaaaaaagcaccttttccaatgtactgcagttttttggaaaattctgctttccgaactctgatgcaacacgaaaatgcttcctgcttaattctttctatgttatcaaaacacagttcatttaaagctgtacaatttgcaaagctctgttttccgacttctgttaccgatgaaggaatctgtactcttttaatttttacgttattcatcagtgcttcatcttctatctttctgcaatccgaagccagtaccagttctttttcccgtactttctttccctgtgctctggtaaaaacatttttttcttttgctttccacgttaatatttgtcccattgtcttatccattcttttccttttcatcaagctaaattggtaaagaaaaagaaatctcccagatcacgggaaatttctttctttacttttcgcatgccagagttgctgtcacatatttaaaatgtttattcacatacacaaaaataaatttactttcttttcccgaaaataaatttaaattcacaaaacggcagttttctggcttcacaacatctgtgttacagtaggggaaactgcgccggtttctcaccgagcttaccttttaacctatcttaaatcattttttctgttttcattatttcgtcaaggaccgttttaaaacttatttattttctgtaattatactttatttttccatttttgtaaagcaagtttgaaactttcttttagcaatatcagactttttatatgcaacaaatcctgtcgtcgtgattatcatctcggtcaccggaaagttaaatcatcggagcaattccatcaataaactttttcacatagaaaagagccgcaccgattgccggagtgtactgtccatttgtcccaactattagattttcttttggaaactcaaacggaagcgatgaattgatctgttttaatagataattcaaatcattctccataaaatagggtgccagatacccactgataataatcggtccgtcaatgaccagattcagatttctcatggcaaatgccagatgttttaaatactctttccagatttgctttatattctcctctttattttctcttagtttttcaaaaaattcctttattgacattcctgcaatttcagacagtgaatttgcggaacaataggtttccaggcagccacggtttccacaataacacagcggtccatctgaattaatgcaaatgtgttcaatcactccgctatgcatgaaacttccttcatgcacctttcgatttgtaataatcgctccaccaaggttgcgatttaataaaaacaccactgcactgtcgagttccgaatgattccataattccagataagcagccgcttttgaatcatgtaccagacggcatggataaggcagcttagaagaaaaatcagacagacgcatcttcacattattcataatcgtaccatacatgactctggaaccatccggagaaataattccctgagttgcaatcgaaacaccaaggattctttctttctgatatttgtattcttctataaattcatctattttatttgctaccttttcataatattcttctgtatcgctataatccaaatcaatggtgtcttttgcaatcacctttccatataaatcaattgcaacaatataaaacattttttttaaaattccaattcctattgaaatccggacatctgatacaatctgaatcacctgtgcctttcttccacccgttgattcgaaatagccatctctttgaatcagaccttcttcttcaagcacatttaaattttgactgacagtagacagacccatctttaaatcctgcacaatctgaagttttgaagtctgtttcgtacgataaatatattgatataccttttctttattaatctgttttaatgtaatcgtagtaacgcctcgttcgctcattttgtcctccttgcttttccatacttttcagtcatagttccattttaatacagtatactatgaaacgcaaacaagaatattttatgtgcattttaaccaaaatgagttttaaaaaattgttttttatgtcaatagacatatttttcctcttattatatacttaacttacagttaagtaataagcgtaagtaaaaagaaaagtattaaaaaaaaaaaaagaaggaggacggcaggtcgctggttttaagagccatgttattgacaccaatggtgccggagattccttctggggtggattcttatatcaaatcaatcaggtcggaaaacgaccggaagaactttccttgaacgagttggacaactttgcacgattcggcaatgctgtagcaagtttatgcgttgagaagaaaggggcaatccccgcaatgcctgatttaagcgaagtcgaaaaacgagtcaagcggatattcgacaaataaacaaaactattcaatataagaaagaaggaataaaacatggatttaacaacttactctaccggaatccagcacattggaattcctacaaacgacattgaaacaacaattgctttttatcacaaacttggatttgaaactgcatttgaaactgtaaacgaagaagccaatgaacgtgttgctttcttaaaattaggaactcttgtcatagaaacttatgaaaataaatcagctaaattagaatccggtgcgattgaccacgtagctatcgatgtcaaaaatatcgaagaaatttatgactatattaacgaaaacggactgaatacaacttccgatacgattcattttcttccattctgggaaaatggagtacgcttcttcacaatcgaaggaccaaataaagaaaaagtagaattcagccagtttttgtaaaactcctactggtaaaaaaataatttaagaatgagggtgtcccaaaactatgatttataaagtcagacatagagaggggcatccttcttctctttctttaaaataacgatttccattaaaaatggcactggtttcttatccttccagtgccatttttgcgatattatgggcaattgccaacagtccccattcaattttaactttgtctgctccacgtaaatgaaatcgtcggaatgaccaacaacctttgatcctgccgaagacctgttccacttccacaactctttgtgaacgaagcttatgtcctcttttggagcaaaggtttgcatttgctttcctttttagttcatttagccggtgggataccatgattgtacgatttttatctgtgttcttgcattccgttgcatatggacaaccagtacaatcctcgcatcggtaataatcccttctggtttcatacccggcttccgtcacatatttccggtttccaatatgtaacaactgctttccgttgcggcagacaaagcgatctgtttccgctatatagggtaagttatctgtcagatacggattctctctgtttttctttttcttttcccaatgaaacttgttatatttcacatagctgcccagattcttttcttccagatattcataattctcttcgctgccatagcctgcatctgcaacgatgttttccggtaatcgccctaatcttttttctaaatgttttaagtgggggatcatggttttggtgtccgttggatttggatggatggtaaagcctacaatatatctgttttcagtgccgatttgtacgttatagcccggttttagctgcccgttaagcatggcgtcctctttcatacgcatgaaggtggcatcatggtctgttttggaataactgttgcgtccttcaaatatagcaaaggcctcttcatatttttgttttcttggaaggatatcttttttgaattccttcgcttttttctttaattttttatccataggatttttggcaagctttttatctatgcttttcacaacaccttccacctgccctgtcgtaatgcggctgtttacgcccgtttcttccaaatcatcctctaaataaatctcattttcctctgccacaatgcggtctatttcacgaaggtggttctttatcttttcatccagtttgcggtcatagttgcctaccgctttattccatacaaaagtatacttattggcattggcttctattttcgtaccatccaaaaagtaattctgcaactttatgtattttttttcaatcaaaagtttgacgacttcatagaacacatcttctataacatccttcatatccaggcgaaagcggtttatcgtccgaaagtctggtttgtttccgcctgcgatccacataaagttgatgttttcccgaagagatttcgctatctggcgagaagagtatgttttctgggagaatgaatagatcataactttcagcatcatcttagggtgatacgccgggcatccgccttctttgtatctgtcgtagagtggttttaaatccaaacattccacaactgtatttacgacccgcacaagatgattttcaggaatgaaatcttcaaaagacagtggtaattgtaattgagccatagtataatctttaaatgtaggcataccttattatatcacataataaggtggaaatggagaacggcgtggtaaccgttctctatttttttacacttttttacggaaagcaagagggcaacccctcaagtcatttcatgacttttgggacaccctcttctcccgttgaccggagattctgaaatacgcgggccggaatgattccttcccggaagtccccgccggtctccagagcatcggccctggcggaaaccggccacagggaaaagccagggcagccgccagcagcatgctgcatactttatatttcatagcttatctctccattctgccggtcctctgttttctgccatatctacaacctcctgctgtaaaagccttttagcccccgcccggacagaatccgggcagaggcttctgactgtttttctgtttttttatttttccgccgtgcttctttttctgctgaacactgcgaggacaatgcctgcgcccaccgccagaatcagcgccgaaacatacggcagcagatccgtttcatcaccggtctggacacttcctgttcccgccgcgcctccagctgtggaagaacctgtaccgctgccggatccgtttcctgtgtctccagtgcttactgtagacgcgtccacaactgtgccgaacttgcccagcgtgctcaccgtcactttcagaaccccttctgttactgtcccagtcagcgtttctactttgccatctgccacatgcagaaccttcaaagtctttccgttgtatttttcgcccacctggatattcagggtgatctctccctccggctgaacttcctgtccatccttatagagagccgcactgtacaggcgaatcagggcttccttcgaggtaatttccttctgcatcagctttacatcactgtcaaaagctgtcagggcttccagtctcagttcccagccgctcaggccctttccggtcacagatatcggataattctggtatgtcagtgtcacctcttcatctggagtcggggtcggcgttacatccggcccatccggattctcagcactctccagctcctgaatcctgttctcgcatttttccaggacagccatcgtttcttcagttacatactgcttctgcgcgtccgtcagcgcttcataggcctcgcgggccgcctccactgccgctttatccgcaagcgtcagcgtgtctgccgccggcaggctgttgatctgctctgtcacggcgtccgccgccgcctgatcggccgcctgctcttcaagtattgccatctgttccacggccttctgtaacttttctacaatgtctgcagaaatcaaggatttctgttcatccgtcagcgcttcataatgcgcattcgcagtttttacagccggagcatcttccaatgtaagctcttctgcagatggaagagatacaatttcctgctccacctctgcagctgcctctgcatcatccgtcagctcagcaatctttgcttccagatttgcaagcttctgtacagtctcttcagttaccagcgctttctggtttcccgtcagcgcttcataggcctcgcgcgccgcctccactgctgctttatcctcaagtgtcagcgcgtctgccgccggcaggctgttgatctgctctgttacggcgtccgccgccgcctgatcggccgcctgctcttcaagggctttcagctccgcctccgccgctgtcagaacgctgtaattcgtcacatagctctgctgctcctctgtcagcgcgtcatatgcgttccgggctgcttcaatagcctcccggctatccagagtcacggttccgatctcttcaatcagatcgataactgcctgcgcttcctccggtatctgcggttcttccggattggagggatttgcaattgcatccctcagggcctgctccgccgcatccacagccgtctgttcgcaggtaatgtcgctgatggccgctaccgcgccttcgtaggctttctgcacatttgcgtactccagcagctcttctttatcctctctgccgttaaattccgccagcagcttcgtaatactgtcgccgttcacattcggtacaaacggatcgtccacgtaaccgtttccggaacagagatcccctttcatcgccgtaaaacggatccggatcacatctccgtctttcggctccgtatcactcatgcccacattcggcatatcattgttcagcgtatacatccagccggactgatgattggtataatcaaattcacccagcgtggctcttcttctgggatttgtaattttaatgccctgttcttccgcgtgcttcagggaaatctccggaaactctgccgtcaggcttcctgcctcatccagaatccaggaaagatagaagctgctgtctacgcttcctgtattgtcatagcgaaggccgttttcacccaaaaccctgtcaaggatctgcgccgtggattcgccttctgtgatttccaccaggacaggctcaacgagataaccctggccgatggtgaatttttctatggcgactgtcacgtacgcctgttccggctcttccgcatcttccagctcctgaattctgttttcaagctcttccagagctgtcaccgtctcttctgtcacatactgtttctgtgcatccgtcagcgcttcataggcctcgcgcgccgcctccactgctgctttatcctcaagtgtcagcgcgtctgccgccggcaggctgttgatctgctctgttacggcgtccgccgccgcctgatcggccgcctgctcttcaagggctttcagctccgcctccgccgctgtcagaacgctgtaattcgtcacatagctctgctgctcctctgtcagcgcgtcatatgcgttccgggctgcttcaatagcctcccggttctccagggtcacggttccgatctgatcaatcagatctataactgcctgcgcttcctccggctcttcaccgcccataacgtcggtcatatcatagatatcgttttctcctgccgcgaatctctcccaggccgctacggccagaagggtctgctgcgtagccatttcatttacggcgccgcccttcgtatgggcgaaaccgccgctttcgattctgtactcatctgtcgcggtgaaaatattcgcgccccaggacgtaaatccactgtcatcatccgagggggcgatgcccagcatcagcagcgtcaggattacctggtcgttggattctaccgtaccgtagtcgcccatgttaatattgcgcttcaggtagtccagcgctttatcgacagccgcctgcacatcctcccggtctgtatatctggacagggcctgcaaggacatggccgtcatatctatggagcctgttccggataccggtttggaaagcacaaagcttccgtcatctgcctggaaggataaaagctcctccatcagcgtatcccggttccatcggcttccctctggaatatttactgcatttgcatctaccgccagcaatgcgtaagccgcctcattggtgccttcgctgatcctctcgctgtccagtatccactggatcaggtctaccgtacttccgtcctccatctcaatgtttctggggtcgagtcccagggcatacatagccagagctgttctttccagatccgtgggctttccgtcagccgtcagatcaccgtactcgtctgccagctcctcctttacagaagcaagataagcctctttatccactcccatgtcgataccggcacgctccagagcgatgatgttccactccatcccgtatgtccaggacggttcggaaccttcataatatttctgaatagacgccttccaggtgcttacaagctctgtggtatccggaagcaccggtttctctccaccgcttcccacatgaatggtaaatgtcacggacgggcttgtaccctcggcagccgcagccggggttcctgtaatggtaacggttccttcctttacgcccgtcacataatagttggtattggagaaccagtcgtactcgctgttcaccccgcgggtcacttctacttctccgtcgccctcctgggtccaggtgatcagggcctgggacggctgctgcggggtataaacgatgggcagggatgcctgctcccctacctggatcgtcagctcgtcttccccggcttccagtttttcaatgggatgctcccagtaaaaagtcacatcgtcacttgcggaaacgggattctctccatcctgcacggatgcggtaaccgttatcgttcccgcattatggccgatgattccattctcaaaagtattccaccactctcctattgtttcatcgctgctgctccactgtacgtcatggatatagcttgcatttgccggagtgacggtcagggccgcattcagtatattctgctgaagtccctgatagttatcgccatttccaagggcataattcagccggtgcagcgggaaggttttcggaagctccagcttcatgctttctatcgggacatatgtagattccatatggatcgtgtgcgttttcccctcgccgtatgttattatcagatcgccttctccgggctcggtaaattcaacatacgtaccgctgtcgtagacagaaatctccatccggtcattgccctggatctcataatccgctctggaaaggctgacaaatttttctgtcccctggtattttccggaaattgcaagttctacggacgcgctgccttccagtgtccatttgcctccgtcagctacagtctcatcattgatattcacccggagctcctctatctcataggcgacggcctgcagcttaaaacggaacaggataaaatcataggtaccggtcagatagggagacttggagccctttaacgcgacctctacggtatccggcgacgtcacagttatatctccggtataggtacctacgcccacgcctttattccagctttcctcgtccagcacatcccatatcgtcatttttccggctcccggcgtatagccctccatcacgacctttccgcttccggaagttgggatggtgaatgtggagccattctctatttccgtcttttcaccggtatcactgttttcataataaactttcaggtccgcaacttctacggtataactgtaaatagcctctccttctgcgttattcagagaaaccttcgtttcacccgcacccacggctgtcagggtgccagccgactgtacctctgccacctccggattggaagaaacccattcactggcgtctgccacgttctggtagctgaattttccggtatctcccacaggaatggcaaagcggtacccgttatccagcgtaatgcttctgttttccgagtcctgatggtaggttacagacggatccttcgcaatatccgggtcttcccgggtcagcgcaaagctgaaatacaccttatcgacctgatagctgctgttgtaatgtacgacgtctacttttgaggaaaccgccgcatccgtaaagtacaggctgtttcccacccggtagaaattactgtctccaaagcgcataccggtcatactggactcttccgccggcacgccctcataatacagctgtacctgtccgcttgcatattccggggcgatattgacggtatcacccgcctggacttcctgcggatcgccgtcgggcagtacataatatactttcacggaagactggggttcctcgtccagggctgcgtaagcctcctccgccgcggtcagcgtttcataatttgaaaccagcgccttctgcccgtctgtcagggcgtcgtacgctttccgggccgcatcgatggcgtccccgctctccgctgtcacctctccgatggcatcgatcagcgcttccactgccgctgccgccgcttcatcatctgaaattgccgcaccctgccaggacagcaccggataaccgagaccgccggcatctcctgctttataggcgtctcctccgttattcagagcgcttaaaaattcatccatatccttcgggatctgtgacgcgtacgcatcgtctccggacgcgcagtagttattgcttcccggcgcggcatcggaatatcccaccgctttagccgcagtggtatagcagttgctgaccgtcgtttccgcgcttccgtttcttccgataattcctcccgcgtaagcaaagctggttcctcctgtcaatgttcccagagaataacagttttcgattacgcaggctgcccgggcttcacctacgattccgcccacatgctccatggaatccgccgttaccgccacattcgtataacagccggtgatggtcgttgagccgtttgcccgccccaccagtgcgccggccgggctgtagccgggatgatttaccgtaccttccagtcccaggttctgtatcacggcgcctttctccgtggaaaagaagaaaccggccccggaaatttgcagtccgctgattacatggccgttcccgtccagggttccggcgaagccgctgactggtgtccacggcgccgtcagttcgatatcagacataagacggtaatttccgtcagccgctatttcccgcagcccgttctcgtcataaatctctaccacgccgcccagcagggctttatatgcctcttcggccgcctccagaacatcgtaattggaaacctgtccctgctcctctgatgtcagactgtcataggcctcccgggctgcgttaatggcatcgtcgctttccttagttacctctccgatggcattgatgagctctataacatgctgtacagcctctgtctgatctggctcttccggctgttctccctgatcatgctcgttcaaaaggcgtacggtataggttgcgcccttatactcaatcttgaactctgcagatccctgctgactgagcgcgctgtccagagcggctttcaaatcagcggaaataccaaaggttccatagttcgttgtgctgtaatcataatcactgttttcccggatgccgttaaaatccagatacaggttatatgcatccagtccattcacgtccttcagagctatgccgtattccgtatagctctgaagagggctgttatttttcgttgtccgatccagaagcggtacttcaatcaacccgctttcgtccggataccatgccttgtcggtctccagcccgctattcagatcatactcctgcagccagaacgacgcgctctcatcattccctgtccgctccgcatctcctccggcagcatataccggcaggcttcccagaagcatgacaaaggtaacaactaccgccagaatacgtttcatttttttcttcatgttcttcctccttcttgttatttcattttctcctgcttctgtccggctaccctcctctaaaacatttcatgcattttctcccttcgcctgttttttcctgctatatctgcttctaaataaactggctatatatcgtttatttcaaacaaataaaaagcaccatccttattatatcacataataaggtggaaatagagaacggttaccacgccgttctctatttttttacacttttttacggaaagcaagagggcaacccctcaagtcatttcatgacttttgggacaccctcattctttttttctatccataactttttgatataaatagaatcaaaataaatgatttaacgaatttttgaacttatgttatgattacaccatcaaataattaacaattagaaatctattttactaggaggaaacacatgtcagagaatacttgtcttgaaaaacagccattatctcaggaaatgttagataaaatggatgcttattggcgtgcatctaattatttatctgctggtcagctttatctcttagacaacccgcttcttaaaaagccattgtctatggaccagattaagaaaaaaattgttggtcactggggaactgtaccaggtcagaactttatttacgttcattgtaatcgtgtaatcaaacgttacgatttggatatgattttactttccggtccgggacacggcggaaacttcatgattgcaaacacttatctggaaggctcttacagtgaaatttatccgaacatcagccaggatgaagaaggtatgaagaaaatgttcaaacagttctccttcccttgcggtgttccaagccactgtgctccggaaactccaggttctatcaacgaaggtggcgagcttggttattctatcgctcatgcatttggtgcagtatttgataacccagacttaatcgctactgtagttgtcggtgatggtgaagccgagacaggtcctctggctacctcctggcaatcaaataaattcttaaacccaattacagacggtgctgtccttccgattcttcatctgaacggatacaaaatcagcaaccctacaatcttctctcgtatttctcacaaagaaatcgaaagctattttgtaggatgcggttgggaaccaatcttcgttgaaggtgacgacccaatgacaatgcataaactcatggcagaagctatggatactgcaatcgaaaaaatcaaagcaattcaggaacatgctcgtaaagaaaacgatgcggaacgtccagtatggccaatgattattcttcgtactccaaagggatggacaggtcctaaggttgttgacggacttcagattgaaggttctttccgtgctcatcaggttccgattacaatggaaaaaccggaagaacatctcccactgttacaggaatggttagaaagctatcatccggaagaattattcgacgaaaatggtcgtctgattccggaactggctgaacttgctcctaagggaaatgctcgtcttggttctaacccacatgcaaatggtggtcttttactgaaagacttaagacttccggatttccgtacttatggaatcgatgttgaccctggaaaaacaaaagctcaggatatgattgaacttggcggatacatccgtgatatcttcaacttaaatcaggataacaaaaacttccgtatcttcggaccggatgaaagtatgtccaaccgtctctacaaagtatttgaagctgaaaagagagactggaacgcagaaatgcttgatacagatgactgcctggcaagaggcggacgtattatggatagtatgttaagtgaacatatgtgtgaaggatggttagaaggttacctgttaacaggtcgtcatggcttcttcgctagttacgaagcatttatccgtgttgtagactccatggctgcacagcatgcaaaatggttaaaagtctgcaatcagctttcctggagacagccaattgcttccttgaatttcattcttacatcaaatgtatggcagcaggaccacaacggatttacacatcaggatccaggattccttgaccatatcgctaacaaaaaagcagacgtagttcgtatgtatcttccaccggatactaactgcttattatcctgcttcgaccactgcatcaagagtaaaaactatgtaaatgctatcgtagcatccaaacatccaagttatcagtggttaagtatggaacaggctgttaaacactgcacacagggtgtaggtatctgggaatgggcaagtaatgactgtggtgaagaaccagatcttgttatggcttgctgcggtgatacaccaacacttgaaacaatggcagctgttactatcttgcgtgatgaacttccggaactgaagattcgtgtagtcaacgtagttgacttattcaaactggagtccaaccacaaacatcctcacggattaagcgacagcgaatacaatgcactgtttacaacagacaaaccggttatcttcgcattccacggttacccaactctgattcatgagttaacttaccgtcgtgacaaccagaacgtatctgttcatggttatcaggaagaaggtactatcacaactccattcgatatgagagttcagaatgaaatcgaccgtttcaaccttgtaaaagatgctatcatgcaccttccacagttaggaaaccgcggttcttacctgattcagaaaatgaacgacaaactggtagaacacaaacagtacatcgcagaatacggacaggatatcgaagaagttcgtaactgggaatggcatacaccagaaaataaataattaacgttttctatgatacaaatttctctataaagtaaaaaaccccggaactgttatctgacctccaacagctctggggtttctattattctctatcatatcagccagagtaccacgtctataatacttgcataggcgtgggtgaatggctgtgttttattttattccctgatttttaatataatttttcactacatccagagtattttcacttacggttgcaataaaataactgtcagaccaaaaataaggtttccagtaatactttttaagcagtgtatcgccataaagcttacgaactttgcgggacgtctgagtttttattacattgacaagttctgacggaggagtctgcgggttcgcttcaataagcagatgtatgtgatccagtttcccatttaactcaagtatattaaaccctctgctttcagctacataattaatccgttcatagacagcagtttttacatcgccggtaagaaccggatgtctgtattctgttacaagtactatatgatatcccgcagatcatggtgttaatttaaaactcccgggtagaaaggaacgcctttatctttcaaatgtagaagcggattccgtcctcaaagaggttaaaatcaagccttattatggaagatacatcctgtgtcttaccctcgaaagtgaaaattttgccgcagataatacagacatgcccaacctatgcgccatagactttggtgtgagcaacttcgcagctgtcgtatgcaatgattgttcatcaatgctgtacaagggcggagcggttctgtcagagtgccagtggtttcacaaaaagagagccaaagctgtcagcattatcacaaaaggccatgaacacatgcatgccagctccaggtacctgagcgccttaagcaggcatcatgccgatttcattaaggaccagtgccataaaatcagccgcagcattataaactactgcatggaacatcacgccggtacacttgttcttggcgaaaacaaacgctggaaacaggactgcgacatgggttcacagaacaaccagaactttgtctcaatgcctacagggttgcttaaaaggccataacggatgcatggaacagcataactgctttttcattcctcgcatcacctgaagtgtcaggattccacgaactgaatcccctaagtatttccgtaaaagggatagcggccgcgtgaacggcctcgacaggtggtggacagcttataaaacgcaataaaatggtgtgatatgccattttattgcgcaaattcttttttgtttgtagcgtttttataataataaaaaaagaaccctttcggattcttcttcatgtttcttataaacatgtaccttcaaaactacatatacaaaaccgaaaccatgcagacacttgccgctccactgatttctcagcttctggtcaagccctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctctttgtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcctttggattgtcacacggtttttcctatgtgactcctccttcgcttgccccgggattccattcccgggttgtgctttccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtattactacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgccttaggcgcttaaccttgccagcatgcacaactcgccggaccgttctacaaaaagtacgcggttccgcatataaagcggttccacagcttgtaaacacagggtttcaggttctctttcactcccctcccggggtccttttcacctttccttcacagtactatgctctatcggtcactaaggagtatttagccttacggggtggtccccgctccttcccacaaggtttctcgtgtctcgtggtactctggatcctgtcttgtcctctttcctttcccatacggggctttcaccctctctggctggctttcccaaaaccattctggtagaattaaggaatcaattatacagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagacatctccggctcattggatatttgctcctccccgaagcttttcgcagcttatcacgtctttcatcggctcttagtgccaaggcatccaccctgcgctctttcttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacattcagatgtaagtttttgtaatgccatgaccggtagaactttgttctggaggttgcgagcatcacactcactcttattcatcttttggctgttttatcagccattcaaacacaaaagctttttatgcttgaatcactggtaaaatcaccatttgcttattttattttttgtaatccggcagccacctgctttcccatgccgtctccagcatagtatcatcggccgcttaagtcttaaccatcgtgttcgggatgggaacgggtgtctcccctaagcgcatcgccaccggaaatgtttggttattaaattttagaagttttccttccttaataactcaacagtgaaacacttcttaactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcctccaggttatccctggcagtctcatcagagtgcccagctctacctgctggctactgacaataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacactgtaccatgcggtactgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggctatctatcccttttactgttttggttcattgaaccgttctttttaaaataaatgaatgtaaaagaattttcgttttcatgtgtttcactgttcagttatcaaggttcctgtcgttctttttatcagcgacagcttctatattatatcaaagctgtttttgtttgtcaagaacttttttaacttttttcaaagtttttttgttttgactattcgtcgttgttgtcgtttccgcgacagctatattagaatagcacacctttttttaattgtcaacactttttctaactttttttaatattttttcattcatggaaaaatctacaattgatacatttattgagttctgttttctcctagtgtacagcgtccaagaacaaacttacgaaatacagtagatgcaatactttgaggatactctaaatcgtatactaatgatacacttctgtccggcatttcatctaatatttctatctgaaatacatttccgctcatcattgcctcttttacaaactccggtggcaaaaagccgattccaagattatgttcaattgccggaagcagtaaatctgttgttgcaaattccactgcgggttcaaacggtagtccgcgctttgcgaaataagaatccagaaaaatacgggtaatcgtatcagaggtcagactcacccagggataatgacacaattcacctaatgtcatcatacgcccctttagatttcgatattttctacccgcaattaaaatatctgtataagaatgaacggtatgttttataagagggtcttctatcgcaaatggaatagaggaaatcattgccatatcaacctggccttttttcaatacttctattgatttttgggaactattatttaaaatcttaaatcttacctttggatgaactttccgaaatgcctcaattgcctgaaacagacaacaatgaagtgctgtttcagttgcactgattgtaatagacccttcatctaccgacattaaatttgtaattttttgttctccacggaaaaactgtgcacatcctgctgagacatattcatagaaagttttcccctccggtgttaattccattccacttttgcttctaataaaaagacggcatcctaactccgcctccaatttatggatcgttcttgtcacagcaggctgactcgtctgaagtgctgatgcagcctttgtcagatttccatattttgcaacataataaaaaattctataatattcaaaatttgagttcatttttttatcccgctctcttacctctgtccgcttcactttctgctttgttttttcttcgtgcatcattttatgatgtgagtgtcaaaagtaaattttgccactcactgatgtaaccggattgctccattgctacgcaattcctgcaatcctcgaacacctcaaactcccataaaatggcggtattcacaccattttattacgttttcgttgttcggcgtgtcaattaagtatgaattgctttttgtgcaagcgcaagcgcaatttatacttttgacacttacatcattttatcacaaaaacaaaactttttgaaactattttctcttctaatctgtctaataagtgtaagataaaaaaaacatatctaaccgaaaggaggtttaaaaagttgactgatttaattaaaaaagcaatttacggcgataccgatgcttttcttgaattgatggacgtcaattcactggcaatgtataaagttgcaaaaggaatccttggaaatgatgacgacgttgcagacgctgtccaaaacactatcctgacttgttttgaaaagcttaatacgctaaaaaagccccgctatttcaaaacctggatgattcggattttaattaatgaatgtaataagattttaagtcattataagaaattcaactgggatgaagaaattcctctcatcggacaaatggatatgtctattgccgaatttgaatttaaagaaatgctcggacgtattgatgcgccttaccgcattattttactgctttactatgtagagggctttcgtatctccgaaattgccgaaattctggatttaaataaaaataccgtaaaaaccagactttcacgtggacgacaacaggcaaaaaaagaatatcttccaccagcttcaaaaaatgatactcttccacaaacaatttctattcaaacaagaaaggggtaaataatatgattgataacaagaaacttaaaacaacgttaactacaaattttcaacttccaaaacaagtcaatcaggcaaaggaagaagcgtttgcaaaaataaaggcatctaaagtctcagaagcagcaaaaacagaagtttcttctactatttcttctacttctgaaacagcttttgctcccaaaccagtttttacttctgaaacggattttatctccaaacccgatttcactcacactccttcaaaatccggttataagcaaaaattttacaagggttttgctgctatagctgcttctgctgccattttttccattatatgcaccgcaaatccagctctggctgataatattccggtggtaggaagcgtgttccagacacttggaaaatcacttggattctacggcgactttaaacattatgccaaaccgctcgacaacaacagttcaaaagattcttctgctgattccgatgcatctgcttcttccggtgaaactaacaccgcatccgattctctttacagccagacgcaaaatgggacaaccctgactttatccgaagtatactgcaatgacagcgcactttatttatctatgaccattcagactgaaaatgaatttccagactgttttttaaatcaggatcaaaaaccgattattttattcggcatggattctactttaaattatagcttcaaaaatacttctgaagataatacacttttaaatgcttatctggatggaaagcagattgattcccatacttatttcggcgttctgcgcctgaataaagaagatattttgactagtgaaaacgaatccattccagacaactttaatatccagcttaatgtaaaaaacatctgcggttataaaccggacgattctgctcctgaaatgccacaggacttaaaagatgcctatcagcaggctatggctgaaaatggtttagatgaagataattataaaaattttacggaagaacagcaagaaatcgaacaccggctttttacagaaatgtggaaccggtactatgaacgttatccggatgttacagaaggtctgaaccattataacacctggaccttagaaggggactggaatttttcagttgatattgagaaaaacacctccgactcgattacaaaggaaacaaaggcagttgattccgatggaaatggaatactttccgttaccaaaacacctttcgaaatttctcttgatgtaacagaccctgaatttaaatattttgctgttgtgcttgatgcagatggaatttactgtcagccaatggcacttccggctctgcatatacggttgctgttcaggacagcgatgtctcttctatctccgtttatttatgcgattatgatgaatatatggatgaactaaagggatattatttctcagaggattatcaggaaaaagccaaaacaaagacgtttaaacagcttctcgatgaacatgctgttgcaagtgatactattaactttaaaagataattactgctttatctaaccttaacaaatctaagataaaacccaggtactttcaatttccagtgctgaaagtacctgggtttttactctatgcttacggtattaggctgggtatgaaaacttactacctcacttcccaacgactccatttcttttgcattttcaggtgttgtatattttcccgtttcatcatacatcagccagtccggtgcatcaaaaaatgcaagttttggggaaacttcttcgtaaaaatcttttagaagcccgccatttccatgatgtcccatctgaatataatctgcttttaacttttctccccatgtatcaagcagataatcactcatcgcttttccaacatctgcacaaaacaacatactggatttttctccctgcaccttaaacatcatagaaccatcatttaaataatcctgtgataattcctttacatgttcatcataggcattataaatatcaactttaagcccgcagatattcagttcatctcccggataaacgtattttaaattttttacattcaaatccaaaaaatcattataagtatccacactatcccaatgtgcacgttcctgacacaatttcggtgacggcatatctaccgtataaacttccttgatttcaattccctgcaaatctgaataaattgcattaaacgctccaatatgatcttgatgtggatgggtcaaaatccatgcatctacttttccgcccatctctttaatcgtctgacgcacaaaatctgcatcttctgtccagccaccatctacaacaattaattgcccctttccaccatacaatgtataaaacatagaatttacatctcttggaccatattgtgtaatcagccatgtcctttccgtatcctcaattattttttcatactggataaatttaactgttatgattccgaataacaaaacgataatgaccagtgctacaccaatcattttgtttcttttttttgatttttttctcatcttttcctcatctaattttttatatcaattctccatcaaatgcttcactaatttcttcctttaattcaagaatgatttcctgatgattttttcccggaatcagctgaattaacttgattccttcctcttctttgtcaataatatttccttcatggtgtgttggatttaagacccatacacgatccacaggatttaatttgcgaagcacaaaattttcatccagccctctgcagtattttgaatgaagttcatttttatatccccgaatttgattttcacaaaatgacttcgtatccctattttgcttttttgttttatcctgaaagatactctgtatcttacgatattttacctcaaaaataatcgttgaccagtaaacatcttctctgtataagtccattcggatatcggggcgataatgtctgcctttcgtaaataccggctgattttcttttgttgtatcctctaactgcctgcacaatggttcatcataatgaagctttatccgaaattctcccttcacaaaccctacaaccgtacctgataaaactgcagatttcctgcaccgtttaccacacaattgctttcctttaaaccattttgcttcacttcttcttccgttgccaaaacacctagccagcttgtcttattttctttcataattcctatcttatcctatcttacttttttcttcttcgttacttgattcggttaaaatccgacattttcgacagtctttgttttccataaattgttttatttccattgcaggcaaacgcaatcatgcatacaattacaaaccacaccacatgttccggaccaaatacttcaactccaattaaaattggcgcaatcagggtatttgtcgcacttccaaaaacggctgcgtaaccaagtcctgccatcaataaaacaggcagacccaaagcagaagccagaatgaccccaagtgtcgcaccgattgagaaaagcggagtgacttctcccccctgaaatcctgctgcaagtgtcacaatcgtgaatactgcttttaataaaaaatcaaacacatagaccttttctcctgcaaaacttgcagaaatcagattcgttccaagtccacagtaacgtcctttccataaaagtaaaaacaaaattgaaaggatgatgcctgtaaagaaaatcctccggtaaggattttttataaatttcgccaatttttcttttgcaaatgccagaaaatacgaaaaggctccgcctgtaattccaaacacaatcgcaatcaaaatcaatttggcaatggtctgcggattcacagaaaacgtatccgaaaaagaaaccgaaaatttttccagtcccaataaatgagacgtgaaacttgcagtaaatgctgcactcattgccggaagcatcgcctcataaaataatgccccgacaactaatacttcaagtgcaaaaaaagtggctgcaagcggtgtctggaacaacccgccaaaacccgctgccatacccataatcaaaaagatttttccatttttttccgtctttccggaaatcacttcaaatttctttccgattgtatgagagactgctgcacctatctgaactgcaacaccctcccttccggcacttcctccaaataaatgcgtaagccaggtagaaaccataataattggaatcaatgccttcggaatttcttcattttcctcaaaaccggtttcgaaaatgagccccattcccttttgcgatttcgggctgattttttgatataataataaaattgccacaccggcaagcgccaaaaatggaacaagaacggtaacgtgttctcctcgaaatgccgtaatgcctaaaagtacccttccaaatatcgcatctactgctccaacgataattccaatcagaacacccatgattgtatagagcaaaaccggtatatattctcttatgcttaaatgcttcatttttctttgtctctctatctatttttttgcagaacagtttgtcagcttacattcgatttgaacttaatgaataaaatgggttgctactcgtttttctgtttccggcagaccaaatgtttcttttccaagtgcaatactcttcattaaaaatgtcatatttcttgcaagtgtacgcatggtctgttttccctcttcatccatctcagcttcacccacttttcttccgtgaatactgttccaatactgactggaagcaatcggcatgttggaaatagtaaaatatttattcagctcatcaaacgtagctgaacatccaccacgtcttgcgcagaccacacttgcacccactttcatcgttttatcaaatggtgtactgtaaaacagtcggtccagacatgcaatcaaagtcgcatttgcagaagcataataaaccggactggctaccacaagaccatccgcttcttcaaacttcgatgccagctcatttacgatatcatcattaatggaacatttcccgttcttatagcaataattacaggcaatgcatccacgaatggctttgtttccaatctgaatcgtttcatattccactccattttcggcaaataccttttccatttcttttactgcaacggttgtatttccgtctttgcgcggacttccatttaaaatcaatactttaaatttttctttcataagtcattcccctttcattaaataaagcgaacatttgcaatccgcttcgctacttgctcatgaacgcagtcgctttgcgatctgtcagtgggagctttcacctcccactgacagaagcatccccctcacccgccgcttagtgctctgcgcacttgaagcgggggaatgcttatctgcgttcaaaatattatttttattttatcacaacacgccctaattgactatatcctcccaaatgccaaaatgcttaggagttaaataaccgattgacagcagcaggaaacctaaggtaaaatattaataaactatatacctgtgacagtcatcagaaacagtaatgttttgagttaaaaagaaaatcagtgcaaatctgatacagatgattctactgtgagacacgcccccaaatatgcacaccggaggaacttcagtagcatatttttgcaggtcgttaagtcagagggcttgctgttacttcgttcaagatttttgaagaaaagaatcttttatacgcagtaacagcatttcataattttaatcaagtagtgtataaaagagctttgattcagaaatggagaaaggctcttttttgtgtataaaaaaatttttccaaaaaagagaagtgtatatagaaagtagaatacttaaaaaggagaaggagtatgaaaaaagaatttaagcgaatgcttagtattcttctggttctcacacttctaggaagtacgctgccgatgtctgtatccgcttccgcacttccggctgaaaacgcttctgcaatcgagaaccaggaaccaaccgatgcatcacaaaatgatacgcaaaatgatgcacaagatgtaacgcaaaacgaaacacaaaacgaagcacaaactgaagaagcacaagaatcccaacaggaagtacaagcttatgccaacacgcttccttccacaattccggccggggaaacttataccctgtctgaagatgtaacaatggaaagcggtcagtggtttgaaagtattgagggaaccttagacggagcaggacataccattaccctgaccgataagccactggcaaacaaggtaaccggaacgattcaaaatctgggtgtaacaagtgaaaaagtaattgaacgcgacgatactttcggaagcatggcaatgacttttagcggaaccattcaaaattgtttctctaccgctaagttaaatatgagcggctgggatgaaccgggcggattagtaggtactgcaaacggaggtgtgatccagaactcttattttgcaggtaccgtaaccggaatgctttccggtttttacggcggtttaattggtgtcaacaactcaaacgataccaaacttaaaaacagctgctatggacctggaagtatgaatggtgccgtaagtatgggtggcaacaaaatcactccggaaaacgtacagcaaaaatccttagaagattttaaatccggcgcagcaaacagcattttaaatactaatcttccggagaccggattttcctgggcaactccgacagatggcagcaatcagggatttccgattctcgtaaagggcggttctaccgaagcacagaaaccggataaaacaaacttacaaaaactggcagacacttgcagtgcccttaataaagaaggctatactaaagacagctggagtaaacttgaagatgcacttgcaaacgcacagaacgttttaaaaaatgaagatgctacacttgaagaggttacaaccgcaactgcaacactgcaggcagcaaaagacggtctgaaaaaagaacgaccgacagagccggtggcacctcctgctgacgcaagtcagattcagcatatctcaactgaaaatgatttaagtaagattaattccagttccgatcagtactatgtactggatcaagatattaccataaaagattcttacttctctatgacggaattcaatggcattttagatggacagggacatgccattatctttgaaaatgcaaactggatgttccagcatttaggggaagaaggcgttttacagaatctgtattttaccggtaccattgatacctgggaacaaagtggaaatggaccaatcggacaaaatttaaaaggaactgtcatcaactgtttttcagatgtaaaaggaagtttagcctgcggttttgcaaaacgtctgcaaggcggaagtattatcaacagctattccatcagcgaaggcaaaaaaggtgttttatttaatcagtataaagaaggcaccctgaaaaatacttactggcaggaaggacttgccaatccggctgaaattccggctgctgctttaaacaactcttctacaaaatcagaagaacagctgaaaaccaaagattttgtaacgctgttaaatcaaaacagaggagcaaatggcaccaaatgggggcaaaacagcaacggctacccttatttcggagaagataaaaattataatccggacaaaccaaatcttccggaaaacaaatatgaaatggttatggtaacggaagcaggcgaaacacttgccatcgaaaaccagacctttactgtttcaccggacgaagtaaatgcatttggaattgtaggaaacttccagttaaaaaacgtgccggaaaccagcacaatttcatggggcatttcagaagtaaaaccagaaggttccttaatgattggatccgacaacggcgaccttcgtatcgacaaagaaggatccgctaccgttactgcgacggaaacaaaggcagatggaagcagcgaagccgtagcctgggtcaaagtcatttcaaaagcgcaaaaattagaagcgatcaagctgtttatcgacggacaggatgtaaccaatcagacctgccaagttgccggctcagaagaaaagaaaatcgaagttaaagccaaatatcagggcagcgatgcttttgtgcctgcaaactcaactcgttttgcttacaaaaccagcgatgactcactcattaaaaactacaacgattcgagcagcttttcctttaaaaaacctggtaccgcaaaaatgattgtgacctcaaaagtaaacaatgctattaccgcagaggtggaagtgacttctacttatgtaccggcaacttctgtaaaacctgcgatttccggaaagaaagtcattcacggaagaaatgccaacgacccggatcagtatgcctttctcccggactacagtggcgtaattgtctctccacaaaatgcaagttatgcagataattggaaagtaacgagcagcgacgactccatcgccgaatatgtagaaagtatggtaaaaggatatgtaccatacaaagcaggtaccgttacttatcgtgcaacccttacacagaccgatccggagacaaaaaaagaatctaccgtatccggtacctctgatgtgacttatgcatatgaaaatccacttactgaagtaaccgcagtgcaagataaagtaagtatggaaaatttcacggaacaaccactggaattaactttcaagggcgaaaaatccgatgccggctggagcgttacttatccagacctgaaatggacctttgataaaaaaggtatcgttaagatttataaaaaagagccgattctgtggaaaaaaggcacagagtgggaaggcgcaccggatttcaattcggttgtcacaaatgatcaatattatgtaaaagcattaaaagaaggaacggttgtcgcaaccggtactcctcttgacaacacaaactccgccgctccgattcagattacaattgaagttgcaggcggtgaaactccacaaattaatatcgacgaactggtgcagaaaggtctgcttggcgcaaaagcacatttacaggcaatcagcccagaacagaattatgaatgtattgagcacgactggattgtttatgaccttcttcgtgccggaatcgccattccggaagaaaaacaaactcaatattatgattctgtagtaaaaaccgtgaaaggctggaaagcaaataagaaacctaccgaaattgagcgagttgccctcgtcttatctgtaatgaacaaagatattaccgatgtaggcggtgtcaatctcgcagaaatgatttataatcatccgaatttaaacagtggttctaacgaaacagcctgggcactcttagcactggatgccaagaaaacaccgattccatctgatgcgaaatggaatagagaacaaataatttccgcactgctgactttccagaatccggacaacggaggctttggattaaccgataacaaaactgcgggtgttgatacaaccgctatggcattacaggcactggcaccatacagacagaccaatgaggcggctaaaaatgcaattgatgccggtcttgcatatttaaaaagtgcaatgtccgattcctatgatatgggaactgcagaaagtacttcccaattattattaacactgattgcgctgcagattgatccattaaattccgattttggtacctcttatagtaacgcaattacaggcttaatggattactactgcgataccacaggtgcaactggtttctgccacgacaagactaataaaaaacgcaatgacatggccagtgtgcaggctttccaggcactgagtgcttatgttcactataaaaatggcggaaaattctattgggatttatcggaagatacaaaagaagttaccgctgcaaccgtaatgcaggcaattgatcagcttcctgaactgaacgagctgactttagaagacgaagcaaccgtacaggctatcgaaaacttgtatcagcagcttagtgaggaagaaaaacaaaaagtaacaaacctcgatgtattagaaaatgcacgaaagagaattgaagcactaaaagaccttggcgaccaaaaaggaaccgtttctctcactatcatggatggaatccaggcagacactcaggcactgagtgcaacagaagatccagccaccgtcagaggcactattctcgatgtgcaggttccaatctatgcacaagactctatgatgagcattattcagcgcgcttgtgaagaaaatgaaatcgatatttcccttcgattccagggcacttatatcgaacgaatcgacggactgtccgaatttgaccgaggctcgggaagtggttggaaaggtaccttagatggcgtcttcccagataaaagttttgctcaatgtaccgtacaaaacggggaagtaaaagatcactctgtgattactgtagagtacaccgaaaatcttggtgaagatttggaagcaaatgctgaattaaaaacactgggcttacagggcggtaatttaaaagaaacctttgagagagaccgttatgagtatactctgctcacaaaccaggatgaaatttctttcacacctgaatttttcaatcgctacagtgttgcaagcattgaagccgacggtgttgcgtatggtgtatctcaacagattccggttgaagtcggaacacagattcagctggtttccgaaaagaatgtgcgaggaactgaccgcagaacttataccttccttgtagaagcacaaggagaagaaaaaccgggtgagcaagaaaagccggacactcctgaaaaaccgggcgaatcggaaaaaccgggtgaatcagaaaaacctgacgaccagcaaacatccgttactctgctgtcaaataaaaagtatggtatttccttaaaaggtgaaggtctgacagatgatatggaactttctgtaaaaccgattaaaaatgaccacgaagatgttgctctgatgaaaaaagagcttccgacaaacaaatctttattctgcttatatgaagtgaaacttctgaagaacggaaaagagattcgtctcccgaagaaagcaacactttctgtttcggtcggaaaagaatatgaaggaaaagaaatgacccttttacattgtgtaaacgaaaaagtagagtctttaaaaggcacagtaaaagataaagtgctttccgtagaaatcaacagccttggcagcattggtgtggtaacggatgtcgctaaaacacaaaacggaaacaataaaactaccagtggaaacaataaaactaccgttggaaacggtaacacaaagaaatctccaggcgcaacagcagcaggaagtggcaacgctacttctgccggcaaatccgttaagaccggagatgagttaccacttggcgttacgcttttgatgcttttggtatctgcgggagctttaggcaccgtgggttataaaaaaagaaaagagagaaaataaagcactgcaaaaagtaagctaacacatttattaatgcctccatagaaaatatgggggcatttttttacgcttttttaaaccagcagtttaatgacaaatctttctttttactctatactaagtattgtcagcaagagagattacaaaaaaacgaattgaatatttgaatcatacctgcgatcaactcgatgaataaagtacgccagtacttcgaggtgtgtggtaaatccaatagacccggaaacgggtgaggggcgcccagtcaaccaaatcaaggatacttcttttggaaggctgccggggtttagtgataaatcccgggaagacggaaaccatcaacggaaacacatatcgcagaaatgcccgcatttaaaagcacggaacttctggatgcagcaatagacgcctacggtgtaggagtaagcctaaggggtatcagtgtggcaactgatatgacagaggtaaagccaacaatgcattctgccttgatgacggagaaatccgcctataacagaagtcgccggtgaaagtagccatatggcagattgacaaaaactcgtttattaatctgaatggacggtgaaatttacaggtagccaatcctgtgcaggcttgtggcgtaagccaagggtaagaagttaggggtcgctccccgaagctcagacttatcttcctggtggcagaatataagtgaagggcacggattgtacggcgaaggccggatcgtaggtatgattcagatattcaaagatttaaacaaggtcgttccgcctcaatcattttctgagacggaacgaccctttttttcgtacattcttatgctccaaattctatttttttcaccagataatctgctgtttcctcttaactatttcaatacttcacaatttttcaagcaccactccattccaattttcttctttccgaccattctaaaatcaaccatcaatgaagttttctcaactttaacgatttttccttttccataaattttatgtttaatccaatctcctgctttgataccttcagaaattttggcttcttcttttctaggagctgtctgtactggctgtccttttgaatttactccaaacaactctgcaaaagtatcaaaatcttttactttttctaccagacctgctcgatacaatcctacaaaacacgctgctgcctttgcctgacagttaatacttttggatggattaaactcaatatctgtaaatgcatcatattttaaaatttcttccacaagtttctcattttccaataatgcatttatataaatataatcataaaaaattgtctttggttcaagtggataaactctgttttcaaatataaatccagtcagcataccactggtaactaatcgtccatctcgttttgcttctcttggagaaacttccaaaatatctttatatggtccacctttttggaatgtttttgctgactgaaatacacattccaccggtactttcttcccgagttctggaacatatttctggaggaaaaaggcactcaaatcatttccatattcctgcatggatttacttgaaatttctaaaatttttttatctggttttcttcttaaaaactcattatgcatcgcagtaatattcttctgtttctgtacctttgcaaagccactattccagtcaaaatcaattgtcattgttctataaaacggtgctgattctttcgctacaaaaactggtctgtttgccataatagccctccactcattttctcttttcatcaggttattttgttgagtttattatagcatgaatttttatgaaaaaaatcaactaatagtttaatttaccgtggaaatactgttctctagttcaattttatttgcaaatattcttctgttgtcataatacttaaatgcaacggcgctaatccctctaagacttttattgtggcttcttctgtttcattatttacaccggcaactgcatctttaaggtaaattacatagactccagcatctatcaagctcataaccgtcgataatacacaacattcagcaactactcctgttacaacaacgcaagaggcattggatgcagcttttcttatttgttctatgctataagatgaatacacggattttgaataacatttatattttttctgtaaccctttaaaatcatccacaagttcatttagccatttatctgaattaacatctgaattttcaatattataatttttccaaattccctgaggttcatcggatgcgatgtattttgtgaaaattattttttcttctgtgtttgattctaataatttttttatctgattaagagagcgattaaaattagaacactcccatttttgtccatttgaatatacattttgcatgtcaattacaagtaaaagtggattttccaataattgtttattcatacatttacctcatgtcaaaatttgattttatgttttgatagaaaaataacattttaagatttaatgatggtatatcataaatttcaatcccttataggtaatgtgcaacaacagcatttcttagaaatcgccaaattcaccttgagactgaccgactttttattttcttcccttccaattaattttcttcattactttctgaactgcattcactactttcgacgacaaatacaccttaggaagttttcgttttgaatacgcccagacggaattattctgtgttttatttgtcaatacctctgtaaaaaacctttcccagctaacatactctttactttcaatataattttctggttttttgagaatatctgttatttccttatctgaaattacatttgacgcaagcaaaagccattcaaaagattctggtgcatataagacaacattttcaaatacatttacatattccataacctctttcatttcagaaccaaatgctgcaccatctacaattaccaattttattttactgtcattttgatttgcctgtaaagtcctaataatattagatttacctttcgcagaaacacatggtattgctttaactttcgacaattctgaaaaaaaatcatatcctgaattagaatcctcggtaataacatattcagggtcgacatttccttcttctgtcaattctccatagatatgataaatttcattgtacttctgttttgcttcatgaaattttcctgattttcgaaatccataaatttcatttacactgtatggaagcattggcagtttttcacgtgtcgcaatcacaaaatagttatccgatttttgtacgacacctgcaaattcttttgaaaataaaaaacgatttccctcatcaataaatataatactgcttgatatctcttcaatttgtcgtttccaatcttcattatctattatcctgcattcacaatcacaggaaacaaagacaccactgtctgctccatatcttctataatctcgaatcaagtcaatcaatactgtttttccagaaccactatttcctgtaagaatggtgatatttctttttacaacaaaatcatattttacttttcttgattcaacaataattctatgcgcacctctcatactactactcctgtaccatttgatttaggtatttacttgctataggaatcagctctttcatagaatgaacaacttctccaccattttttatttttatttcaaaatcagtgtcttttccaaagttcatcatgtgcctgagattaattgttaaatccttctgtttcgctatttctaaaatccattttgcacaattatcaccacaagtagatgcattaaaaattctatcaggttcatttagcattaatagtaacgttttcactccacctgataaccgctctggaggtatttgaccaagaactggacttttaatacattctccacccaatacttcagaatcatctacatcttgaatcatctttttagcaagttctgattcaagccactctgattcataagtgtttttaaaataaacatttgtattataaatacttctgggttcgtctccatatataattgtaagcatattttcccctccggaataatttaaaatactaatttctatttattatcttatcccatcgaaagctaaatatcaatgagaacagtgttttctaactttttgattatccatgagactgaccgactttttatttcgttttctttctattgaactggtatctccggcaaacgtttcctatcttaactttttcaaatacttttctgatatactttccatctttttttagaaaagcatctcctgattccactcatatcccaacatttctgcaatacgaactgccaattcgatgtctaccatatcgctaatcacacctaatgccatatcaaatccagccatcgttgaactgcaggaataaaattttccatcggatatccagttcacaccctctgctcgtctaatttcagcagtaaacattcgtttccagttctgatctcccggataatctgcaatctgtctatgatacaaaagcccggtctgtgctaatatagaagaagcatttgcaatcatcatacagatatctgcctcctgtgctgccgcttttataatttccaattttttcggttcaagacaaagcagcttcgttgcagtacgccctcccggaagtaccaatatatcttccacttcttccggaatcaatagttccgtccaaaccttcacaccttgtttactgctaaccagtcctccgtttaccgacaaataattaatataaaaatgttccggtgccattccaaaaatattagcaattcctaaggcgtctaacgtttcaaactcatcataaagaacaatatttacattcatcagtggatcccctttcgcatcactccaataatatttttattttatcaaatctcttgttctctaacaagccatacagggggataagttactcagaactcggaattttattcgccaaaagccgaacaactgtctaccaattatacttatctgtgatataatagtcgaaagataatcatattcaaacaggaaggatagatatactatgtttcagatttttgtagactctgctgccaatcttccggctgtaatagcaaaacaatataacatcaatgtcatctcttttattaatctgattgacggaaaagaagttacctgctataatccagagctttctttagaagaagaacgccaaaagggtaccgaatattataatgccatgcgcaaaggctgtgaaatcaaaaccggactgatcagcactgcaacatttgaggaacaattccaaaaagcatttgaaaaagaccaggatgttttatatttttctttaagcaaaaatatcagtggaaactttaactctgcacgcttagctgcagaagaagtgttaagtaaacatacaaacggccgcaaaatacgcttaattgactctctcaatgcgtctcttgcgcagggaatccttgcaatctacgccagtatcatgagagaaaaagggatggagattgacgaagttgccgattttttggagacttgcgtaggaaagatgaacggtatcttcacagttggcgatttgaaatatctctcccgcaccggacgcatcaagggaagcgtagcaacaattggaaatatgcttaagattaaaccgattttaaagggagataaagatggctatattgtcacttataaaaaggtgcgtggtcgtaaagccgctttaaatacactggttgatctggtttgcaataatatcgtagagcctgaaaaacagattatcggtatcgctcacgcggatgcttatgaagaatctctgtatgttatgaacaaaatacaggaaaaaattaaagtccgtgattttatcaacacttcctatgacttctgtacaggaagccatgtaggacctgatacaattgcacttttctttatcggaaacgatcgagaacttgctaacgagtgattataaaaaataccaagaggggcgtgaaaaatagctttgttcacacccctcttaactcatcactgacgaatatccacaatgcctgtttccagtgtactatccacaaactcgctgctgcttccatttccggataaattaaggtacatgttcgaaagttgattttcatccacaatccatgccatttctatctgaacacactctcctgattttaaggacgaaatatagtttccaccatttccataagcttcctgtacactgtaataatccatttcaaatgctttcgctacactgctcgaatgaatacaatcataattatctcccgattgctcattttcgatatacaattgataagtgtcaccttttgatttcagcaacatcagatttccgagatataatatatgattcaatgtaacttctgaattattcttataagttgccgtcacaaataccagtttttgtttcacattctcggttttcacaacttcatccagaacttctacaccatctccggtctttatataagaaagctgattttctactaattttccatcctcgccaactgcctttttccattcttccggaatcttattttcatctaataaacttaaatcatctgaaatctgaaccgaatccacttttaccgatacatcttccgattcgattgaattgccattttcatcttctgcagaaacgtctggggaaatcttaaattcttctcctgttttccagagtttcaattcatccgatgacacactcgttaccatttctctggtttctgtttccggctccgttgatacaaaatcactccagctgtacatatcttttgtcgcaaccatcttatctgttttaacaagagaaatattttcagcaaattttaccgcttcctcctttgacatatcatctcccacataaatgactgccatccggtattcatccggacacatcagataaatcctctggttatacgaaccactctgctccaaatcctgataccgaagataaacaccctcgtattttccaaaatttctttcttcactttctaccacatgattgtccgttaatacgctttcaaaatcctgtttatccaacagcatcaggctcattgaaaacccaccctgatacggtgtttccaaattagaaaattttccttcttctacctcttccatcccatccggaaggtagcctgcctgaatttttacgtctggaatttcatccggaatcgcagtcattttgctctgttcattggctgaaatctttgttgccaccttataagttccctgtttttccaaatgcatcgcataccatttggaaccggcataaacacttgtcgatacgcctaaaatacaaactgcggcgactgctgccacacgagttctgctccattttgttttcttagcattttttgttggaaataccgcaatctgctcattttccatctgtttttttatttcatcctgaatccgattatgaatcatttccggagtttttggcatttctttcttgatatcttctaatttcatacgaacacctccttatgttcaaatgctttttttaactttccacgggctcttgccagacgcttttgcactgcaccttctgttatttctaaaatctctgcaatttctctgatactaaaatcttccgcataatataaaataaccggaagttttaactcatcctttagttcagaaaccgcctgatacaattcactgtaatctgttttttccggctgttttcgctccggtatctctgtcgtttccatcgatacatattttttctgcctgcgaagcagactataacactcattaattaaaatccgaatcagccaggttttcgcatagttttcttttttcagcgtttccctcttttcaaatgccttcacaatggtttctgaaattgcatctgcacaatcctcatcatttccaagaatgatttttgcagtagcatataattgattttctgaatttaaaatcaactctcctaaattttctttcgtcaaaatatcaccacccttttctcgccggctgttcaatttcaagtcgaacactcgtgagacttggcgcgcgattctagtcagcacaagctgacaaattcttcttagaatcgctgcggtctacacttcgttacggtccgcgcagaaccattgtccattggacaatgtgcgccccacagagtgtttatctcagtcgtagtcttatcgactgagataaatttgaatgcaatgttttcttacatagattagacgtttatgaaaagaaaatatcccttttattctattatttttttattttgtaacctttttcctttctcatttgtgttataaatgaaaggacctttcaaaatataataggggtaaaaaactcatgagacaatccattcaggaattgattgaacgttatcagaataatctttatgcaattgcatttaacatctgcaaaaatccatccgatgcgcaggatgtcgttcaagatacgttcattcaatattatacaagcaaaaaagaatttgaagacgaacaacatctgcgagcatggctgattcgtgttgcaattaataaatcgaaaaatatgactcttactttctggcatcagcataaagtttctttggaagaatacatggaaactttaacttttgaaacacctgaatcagaaaatcttttcgaggaagtcatgaagcttccaaaaaaataccgaatcgtcattcatttattttattatgaggattattccgttaaggaaatcgcagaaattttaaagttatcacaaagcaacgtaaaagttcgtttatcacgcgcaagagcactgctcaaagaatcattaaagggggaatggaattatgacgaataaagaaaaatataaacaggctttttctggattgcatcccttagaaccaatttctctggaggtaacacaaatggtaaaaatgcacaagaaacacaaatttcaagtcgctgctgcaatccttaccgcattcattttagtcggaggcaccggaactgtatacgcagcaaatgttggcggaatccagcgtaccattcagctctggattcacggagaccagactgatgccacactcgatgtaaaagaagatggctcttataacttgaattattctgatgaaaatggaaatacagtagagcagggcggtggcggagtcgcatttgatgccgacggaacagaacgcccgcttacagaagatgaaatcatggaacagattaatatgcctgaagtagaatacgaagaagatggaagtgtctgggtttattacgaaaatcaaaaaatcgaaatcaccgataaatttgataatgataaaatctgctatgtgaaaattaaaggcaaagaaaagactctttatttaactgtaaaataccagaatggctactgcatttcagaagataaatacccaaaccctgcttcttttaactgattttttatttttcatacaaagcaagagcagttcagaaaattcattctgaactgctctgctttatttttacaagctctctgtaagagactgtaaattaattcactgattttttcttagcagatttctactaattcaatcttaaagtttaattcttttcccgccatttcatggttcgcatcaaaagtaatcacaccattttcttttgaaacaactttaaccgggaatggctgtcccattgcgttctgaagataaacctgctgacctgcttctaattcttcagaacctggaagttcactgatctgaacactgaaaactgcatccgggtttgccattccataagcctcttccggcattaaatgaatgtctacgacatcgccaacttccatatctacaaccgctttatcaaatcctttaatcatcattccagctccgctgataaattcaagcggttcaccacggtcataagaagaatcaaattttgttccatcattaaaagtacctgtgtaatgtactcttactgtttttcctgcattttttccctctaaaataatctgtggagttccacatccatggcatccgccaccgcaatctccaccacagctatgaccttcttcatggtctccacagctgtgaccttcttcatgatgatggtcacaagttacaccggcatcttccagagttccatctaaataatcctgaactgctttatctgtgtcacctgctgcacctgcacacacttcaattcctgcttcagcaagagcggtctgcgctccaccgccaagacctccgcagattaaaacatctacaccctggtcagctaatacacccgctaaggcaccatgaccacttccgttagaactgattacttcactggaaatgattttgttgtcttctacttcgtatactttaaagttttctgttttgccaaaatgctgaaatacttctccattatcataagttactgcgattttcattgtttgtattcctttcgttctcatataattctgatattttttctatagttcatatgataacatagattgtaaggaaaagctatttgttatttacatttcaatatgtttctattatttcatgtacattcaaaaattcatttttaatttttacattatttacattccaatatgtttctattatttctgtatgcgacaaaaaaggaccgaaaatggaaagtgcatttacattccaatatgtttctattatttcgagtcaaaaaggtctgtaatatgacatttcagacctcatttacattccaatatgtttctattatttcgagaattcatccaatgaaagcatttcttgaagaataatttacattccaatatgtttctattatttctaattcttccgtagcacattctaatacagcactgagatttacattccaatatgtttctattattcatcacctgaccaaccgttagtaccgattttaccgattttacattccaatatgtttctattattcaggaatgtgcatacaagcacattatgcgcatcctttttttacattccaatatgtttctattattcgacgattcaggtggattctatgaggtgcggacaggattttacattccaatatgtttctattattcccgtccaatgtagccttttataattccactactattctaccatcttttgtcgaccctgtcattatcttctgttttttcaataaaatcttctctttctttcctaaactctgcatttttcctgcaaagcgtcaattgtcgactccacgccttttttaccttatcacaggtcgacaattttctttctatatgaattctccatctgtttccaattcttcttgcataataagccccatgccttttcctgtttcaaactcaaactcatatttgtatgttgccctatggatatccataacttttcgttttcttccattaccaattgtttttttatcaactttttcagggaatttttgataaattggcagactgagtgttaaatcctggagttttgattttattagacttctcgtttctcttccaatgtttggtttactcaaaaattctattcctacatcaaatacttcttttttttcttgataaattcgttcaggaacaatcgtaatactgttaatatttcttacttctgcttcttttgccagatattccgtaggatgaatatttttaaaaagttttaaatattcttttatttcttgaaaatattgtgttccttcaattttttcaatatcatacactgcattcatataatctgttttcatcttttcagtaaacagttttccctcatagtctttcaaaagttctaacgcccgctcatataaatccttttcgtatacactgttttttccaaccccattttcactagcatatacatgaatatttgcttctgatggacaatatcttccttttcgattacatcttcccattcgctgtaagagactatctgctgtagacatttctgtgtataaaacatcaaaatctatatccagacttgcttctactatttgcgttgtaatccagacacctgttttatccgattctgaaaactccataatatttttttccagcagtgctctgtctcgtcttaaatatcttgaatgaagaagccatacattttcactttttaattccttataatgtcgttgtgcttctaaaacagtattgcaaatgactaatacttttttatgttttccctgttccaagatttcattatacacactcttatcaattttagaatcatgaatttttactctgtgtctggagttaatttctttctcctctacatctgatgtaaaatcttcaaaagagtattctagcccacattctttcatgaaatgctgaagaactggtgaaaatgtagctgtgataatggcaaattttccacccattttttgaattattgataatccatagacaatcgtcgcaataactcgtggttcatacgcctgtatttcatctataattagttttgaatattttaatgttgccgcaaatatttccgttccaagtgcccgataaacaaatttaaataactggtctgccgtgcatacagtcaacggctgtgacagcattttcgcacggtcatatttttcgcaaattccggcttcttcctgtttgtattcttttaaatatttcgccatactgtctgaatgaagcaatgctacatcttcataagagtatttttctcttactcgattataaatcgcattcgatgaaacctttaacggaagagtataaaatcctttttctccgtttagccaaagtaaggctgcctctgtttttccggaaccagtaggggctaccacaaccagattcttatctttattgtttatcataaaactctgtgctggtttcaagctatattgctttaaaatgtttgtggattcgtctgcatttccttcttccattttctgagattctaatttatattgatttaaaatatttgactttaatttcttttcatgtaaatctaccgcagtttctgcttcttcataacctgcacttacggtataatcaaatttattcagcataccttttataagcagatatttattccagatttctgaccaattttcgtactggtattccactattttactgctgtaaaggttgttccgaaataagagtttatagatattgctacagtacaatttgctaatatctttatttaaatattcgcttacctgctgcatataatattttcttccatattctctgattttttctccatcgtaatcatcttccctatcgtgatgataataaatggctgtaataaatggactaaaatcttcttctgaaaactcttctgataattttaaaaactcgctttttgaaagcgtaactgcacttaaaaatccatgcggaatctgctctagctttctgctgtctaactttgtttcttcatccacttccggattgaacatcagtgcttgaaatagaagattcgcttttccccaatcgtgtcttttacaggcttctaaaatcaacaatttttctctgtctgaaaaatatgctccatactgcttaaaaaatgcttccgcacatctgacaatttcttcttcatgctcttttaaagttttttgtttttcttctaaatctttacctaaatcgtctattgtatgatttataatatttatctctgtctcatcaagttcttcttgaagtttttccttaatcttctctaaatcttcttttaacttgtctttttctccttgagataactgccttttctttgtttttgcataatattccatagttccactcttttctggaacagcattatttttttataatactgttccttaaatgattaatataaaactattgctgcatctttttcatgttctgcatctttactttttttatttccatctttttcattttctgcttctctaatttctgcataattgtccgtatatgcgcctgtttctaacgtagtcccttttggacaataatatgctttcactcttcccccttcttttttccagcgtcgaagtccctgttttgtaatttcatattcacgggtcaagctatatacggtcatttgtttatttggaagttcaattttatcctcactgtttttccattcccattctaccggtatatacatatcccgttttaaatctacttcgtcctctcgatgaatttctacaatatcaactcgttcaatatccagtaaatcttcataacgacccaatgacaaatattgaggtggattttttaatgcatgatagactgtcataaaatcttcttcatttggaacaatatgaatcaccaaatgattctcacaaatgagttccacatttgcaattcccttaaacgctccatattttgttccgttatcttcaatgcagatattatgtctgccttctttaaattttgttcctgctgaaaaggtatatctcgtataaagttctgaaatcattccgctgtttgttccttgaatacaaagtttcatcggatgaaattctgtataaccacatgcagcatgaatcattccaagaacagtcgaatacggaggtaatggaaatgtctcttttatgataaaactacttggttttctataattcacaagattttgaaaacactgtaatctaattgctctctccatagtaactatccacttctttctttaaatgtttaaatacagttcccacagatttcgcttttaactctgctttgatttcagtttcattatcaaaaattccagatgtaattccaacaactgtgttttcttctatctcattgtcttcaatcagttctaatagtgtttccacattaattttattaccctctaatttaattctgttctcaaagaatggattctttctttgatatcttccgccaataataaataatggactcaaattttctcttctgcctctaatatctctatataaataatgcaaagaatctaacaatacttttacacgttctgctttttcctgacttggaatatcaatctctccatctactcccactctgtccaaatcaattgacacagtatacgcataataggaacgatgaatttcactctgtgcgattccattttctagtttttgccttacagcaagaccagcatttgtaagaaattccagatttccctgaaatggttctaacgcaatcgcattactcagtcttacaactgcacttctagtcgttgctccacctttctctttttcatcaccttttgatgttgttttcatataaccaaacatgtcaatctccggataatctttaattgtagcagatggtgcaaattgaactactttcttttgagcctgaaccggtgtattatcccaatttgcctgctgtacaatattgtaacgcattgcttgtctggaaatataagaatattgccaatcattccctcttgtcattttcttcaaagaagaaacattattaattccttctccatagtttgcactttctgctaaaaaaatcattgtaattgtaaatccatctctcttcatttaattattctcctttttcccttcgtaacagcctatcaatccagctacaaatgcatatccataagtagtaaacttttctttatcttccaacatttctattatacctgtcggtattaaaagctctggtccattttcattctttcttgaaccataagaactgtacaatctaaatacaacatccataaatctgtccacattttttacatacaacgcatttaataattgatattcaacccctcttaagcaatctccagaactggttcccttagcctgcataattacttttcttaaatctgatccgttttttttcataattccacaatccataataatctcctttcttttctcagctttatctacaatttcataccataattgaatttcataaatacaactagcataaaatttaaaaaattcatcctcaatacactcccttaatacacgatttaataactgatattgattacgctgttgaagcaaatttttaatcacactttcatataagtttggaatttcatttcccacttttacttttgaagaatctgcaaaccgttgtaataccgtcgctacacttggtttacctatcgttttcagcatatgtttatttataatacttagaatatacttatcttcatcctttgttcctcgtaaaattacttgtacattagaaaattcctgtagtttttctttcagtaaaatattaatagaccttgcaaaccacgcagaatatctttcattttcctttttttcaccatccacactggattttcctgattttgagtttgcagctatcaagacattgatattgttatttatatttacaaacacaaatttatctgcaaacaagcagaatcctaatggacttaatgcataaacaaaagcacaagcaggacaaagaaatgcatccactttacagttccaaaaagcagaacgttttcttgtaaaatcatctcccatttcattcataaatgcaatagaaaccttttcttttgcatttattggctcaccacaatctatgcataaatcttttgcttttttatggtctgctttcaaataactccgaaatggttctgaaaaatctttttcaaatagttcccacatatctttttttgcatttgcccgcagtaaaaaacattttccatcccaaaagcgattaatgtaagtatacaccacacttttcataataaaagtttcctcgcattttggctgtttcaaaaattcctgtaattcactcaaacgcttctgaagttcttctactggcagtttatcactcaacttttctttctttaattttaaataaacatctggtgctttaatcttatctttgatgttttcaaacccagcctgataactattcgaaagcagtttatcattgataaattttaaatcttctttctctgctttttctggactccattctccctcagtaattttgtccaagcatcgtcctattctgtccattactccctgatacaccgtagacgaaccaaaatattcaacaaatgccttaaaagccatatccgtccactttgcatcttctgcgaatttacgattaagccataatccctgtgcatcttctgtgattccataatccacatctcttcgagcacctgctgtttccaacaggtactccatccctacaattccagcgttcttcaaaaaatcgcccattgtaattacatagcgttccaccaaaccatcccctttctgaattaagaaaatttagaataaaacagaaaattttccatgtgcctcacttcgtctgcttcccagtcctgctgcatataataaatttaacagttccggatttccagttaacttataaattcctatgctttgatccgtataacgtgacatcacttttgaaaccaccttcttcccttttaacggagtaatagaaaaattgctgatatccatattaatattcagcttttctaaaaacactcttaaattttccttcaccatagaaggaaactctgcatcttcacaagtataataaatatctgtgttatcctctgaattgtgttttctcacaatcaaagaactctgcatttttataataatttcagtatctttaatttcttgaagattttgcgcttttattgctactaatttcatagaatttttattcatcgggtgtgatttattcttcatcaaactaaacgcattataaaactttaacagctccgccatattcgcatccgaaaacgatataaaaaatttatttccccttattcggattgtttcagttccaaatctggcttctggtaaaaaaaacgaccaactgtaggttttgattacagatttctttttcgtataaagctcctcaaaccactcggatgaataatttttgacagaagctttgaaaaaactcaaacctgtacggtccacctccaatggaagttctggattttcaacttcaaattctaggtttaattcggtcatagttgttttcctcttttcttttttccgaaaggactcttcttttttctcatagtaacactatgtttacaaaaaatcaatcatttttataattaatacaattttaatggtttaataaaataccaaaattaaagtcttcctttttttatctttttcgattacaatataggtgttacattttggaatgtaaatttaaatttgtaataatttatactttaaaatagtcccatattggaatgtacaaagaaaagattgcatttcgtaaattgaatgcaatcttttcttttgattttccctcacatttttcactatctccctcacacatatccatagattttttgctactactcattataatgaaactgatattaaaagtattttttattgggggaaaatcaatgaattcatctactataaaacgaatcattatgacttttgttggaatttttcttaccagcattagtgtttctatctttaaagcgtccctgtttggaactgacccattttcctgttttgcaattggaatctggaatgtttcccacataaaatacagtgtcgcttatataattctaaatgccgttcttttactcggtgtttttgtcttagataaacattatattggactcggaactttattaaatctgttttttgccggatatatcgtagaaaaaggtatgcagctttttgatttatatctgccacagagaactctgccagtccgtattttattactcgctattgcagttgttttagtgtgttttgcttcggccctttattttacggctgatatgggtgtctccacttacgatgcctgtgcactcatgattacaaaaaagacaaaactgccatttcgtgtatgccgaattggaacggaccttattgtcacaactctcggattctttatgggcgcaactgtcggcattggaacgcttgtcactgcatttggtatgggacctttaattgatttctttaaccgtacctgtgcaagaccgattctttatcacaaaacatcagaaatttcattattaaaacgctctgcaatgcattaagctttttacaccatatcaaaatccgtgtgcctcttttttaggagacacacggatttttttactctttttttgacattaccatttgactttttggtattatcagtggtagaatacataaaaaataaaggaacctcatatcctatatgctgcctgcgacatataccatacgatattcccttatcatttataaaacagcaaaacatagataggagactttttagaatgtttgaacaacaatttattaacttcatggaaaaatttgactctgtaccttttacaatcaaaacacaagatcacacctatcaaattggaaaaggagagcctacattttctgttttctttcacaaagtgccaagcatgtctgatttgcttaccagcacttctattgccctaggcgaagcgtatatgaacggtgatattgaaatcgagggtgatttatataatgccctaaacatgttcttaggtcagcttggaaaattttcaactgactctaaaaaattaaaacgccttatttttccttctctttctaaaaaaacacaaaaagaagaagtttcttcccactacgatatcggaaatgatttttataaattatggcttgatgatactttaagttattcctgcggatatttttccaaagatacagatactttatacgatgcgcagtgcaacaaagttgaccgaattttggagaaattatatttaaaagaaggaatgacgctctgtgatattggatgtggatggggcttcttattaattgaagccgccaaaaaataccatgttcacggtgtgggaatcacattgagccaggaacaaaagaaaaaatttgaggaacgaatccatgaagaacatttagaaaatctgctggaagttcatttacttgactatcgtgatcttccaaaatctaaaagaaaatttgaccgaattgtcagcgtcggtatgctggaacacgttggacgtggcaactatgaagaatttatgtcctgtgtaaaaagtgttttaaaaccgggcggattattccttctccactatatcagtgccctgcaggaacatcctggagatgcatggatcaaaaaatacattttcccgggcggagttattccaagtcttcgtgaaattattcagattgccggtgacatgcgtttttatacaattgatgtagaaagtctccgcagacactataataagacgcttcttgaatggaataaaaacttccaggctcatagagcagaagttgtagaaatgttcgatgaaaaatttgcccgtatgtgggaattgtatttatgcgcctgcgctgctactttccaaaatggcattattgatttgagccagattttatttaccaatgatgtgaataatgatttgccaatgacgagatggtattaaattttcaaaaaatccctaaagagaaatgctattctttctcttcagggatttctttttacttaaaaaacacagcatcatcataggtggtatcgtatatggtgtcaatcaatttattattttaattgcactatttatttatatttcacagccgttccataagcaatcacttctgctgctccagccataacctgtgaagaaccatatttcacaccgataaccgcatcggcatccatctcttttgcttcatccaccatacgcttcgttgcaatctgtcttgcttcgttgagcatttccgtataacctacgatttctccaccgacaagagttttcattcctgccataaaatctcttcccacattttttgtctgtacaacagttccttttacgattcccagcgcttcaaattccactcccggaatatattcaatacttagaagcttcatcttcttctcctccttcaatctctttcattctgcctgcaagtgcaatccaaagtccaattatcaatgccacaggtattgcaattaaaaataccaaaagcccaagtggtattgggtcctgcgaatttccccacagcataaatccaatggtaagtgccataagtacagtcataaccactgccccaatgattgcaccttttctttttttcttatgaacatccattttgtttacgttcataaactttgcaccctctttctccatctgttcaatttcttccagacattcttccgcatttagagtttccaaagattgatgttccgagatgaggcgttcacagatatcctgcattttcgtaagtccttctttgcgatattccagttcttttaaatgctgttcaaggcaaatctgcaggcttttcttcttttcaaaaagagctttcatttcttcaatagagagatccattttccgaaataacttaatttcctgaagtctggcaatatcttctttatgatattcccgatatccgttttctgcacgttccacatcaagaagtccctgtgattcataaaaacgaatattcttttttgtaatccctaccagttcttccacctgtttgattttcatttttattccgtcccttctcttccgacattttttgaaaatctgtctgcgttgtttctttgtctgtaccttgtttatacgacttccataaggtggaaggtcaagtattttttgagaaaattttgaaaaataaaacattccagtcagcgtacacttagaaatctatgcggtttcacattttacttcacacttttttacttctcataattgcaaaaatagaactaagcagaagtaacatcggataaaacaatttcggcataatctgaaatgcagaaatttctccacccagttcatttaccgctgaaattgccacaagcatctgcgcaccgtaaggaatgactccctgaaaaatacaggaaaacgtatccagaatcgaagctgtctttcttggagtaattccatattcctctgccatctcttttgcgattgggttcgccatgacaatcgctacggtattatttgccgttgcaatatccatcgttccaaccaaaagtcccattccaatctgaccgcctttttttcctcggaaaattttatgaatccagctaagcagagcatcaaatccaccatattctcgaattaacgcacacattgcagccactaaaatcgctaccatgcaggtttcaaacattccggatactccagaacccatgttggtaagtaaatcaaccggcgtcgtatgtccgcctatcagcataataaatgccccggaaacaatacctgtcaaaagcacgacaaatacattaattccaataattcctccaattaataccagtacataaggcaatacctgaaccagatgataagactggctgacatgcccctgaatttctgtctgaaaagataaaaccaaaatcaaaatcagtgttgctactgctgccggaaatgcaatccagaaattttcacggaatttatctttcatttcacagccctgtccattacaggcggcaatcgttgtatcagaaataaatgaaagattgtctccaaacattgctcctcccataacggacgccacacaaaatgccagattaaatcctgacgcctgcgaaactgctgccgcaatcggagtcaacaaagtaatcgttccaaccgaagttcccattgccactgatacaaaacaggcaactacaaataatacggctactgagaaccttgccggaatcagactcaacataaaatatgccacactctccgcactgcttcttccgacaacaccgacaaaagaacctgctgccagaaaaatcaaaagcatcgtgataatatttttatctccgactccctgtgccataacttccagtttcttatcaaaactcaactcccgattttgcagacatgctacaagaattgcagcaagaaatgcaactacaatcggcacattataaaatcccatcggaattttcatcacatactcaaataaaattccaagaccgagatataatacaagaaatacaccgattggcaataacgcaattccttttccttttttcatctactctctccttctcttttttcttaatcttgtcttattgtaccacatcaaagaaaactcttcagcaaaaaaagaaaaacccatagaacaaaaattctacaggttttccaaatttatacaaaatctatttttctactccctactgctttctctcttctctctgcacctgagcgtctgatacttgcaaaaatcgaaccggaaatattatgccatacactaaaaattgctcccggaagtgttgccagtggatttcctgcaaaatttgcagcagcaagtgacaccgcaagtccactgttctgcattcccacttcaattgcaatcgcagtcgttcttgagtattccacatgaaaaatctttgcgacaagaagtccaagcatcattccaaagaaattatgaattgccactacaacaagtacaagcactccacagcttaagattttctctgcatttaccgctacgattcctccaataatcattacaatagcgataacagaaataagcggcataacatcagacaccttatctacatgctcccctgcaagacttctcagtaaaattccaagcaataccggcacaagaataactttaatcacggacaataccattgcccagaaagaaacttctacccatgctcctgccagtacatagaccagaaatggtgtcataagcggtgctgccagagtggacacaatcgtcattcccacagaaagtgccacatctccccctgcaatataggtaatgacattgcttgctgttccgcccgggcagcagcccaccaaaattactcccaatgccaaatctgccggaagatgcatcactttgcaaagcacccatgcagccagtggcataatggtatactgcgctaccgcaccaataatcacttcttttggtctggaaaataccactttgaaatcattcatccgtatcgtaagacccattccaaacataatgacgcctaaaaatactgatgtataatttgtcatccatgcaaatccatcccgccagaaaaatgcaaggcaggaaaatgcaataataataattccaatatatctggatgcaaaactactgacttttccgattttatttaaaatatttttcatgcattatacctcgtagctgaagttgtcaatcaatctggtttttccaatatatactgccattgctacgagtacatttttgtcaattttttctaccggctgcattgtcagtgcatctacaacagaaacatagtcaatttttgaaagtggttctgcttcaattactgcacgcatctttccaagaagttcttctgccatcattcctgtctgaataatttcctgccctgcttttactgctcttgacaaacaaagagctgcttttctttcctctttacttaaataagtatttctggaagattttgcaagtccgtcctcttcacggataatcgggcagcccacaatttcaatgtcaaaatttaaatcttctaccattttgcggataattgccagctgctgtgcatctttctgtccgaaatatgccttgtccggtgctacgatatgaaataattttgacacaaccgtgcaaacacctttaaaatgaattggtctggtttttccacaaagggtttcagataatgtatcgatacttacaaaagcatgcgggtcatggtacatttccgatggttccggacagaaaatcatatctgcaccaaggctttcacaaagtttactgtcacgctcaaaatctcttgggtatgcctctaaatcttctgtcggtccaaactgggttggatttacaaaatctgatacaactacgatatcattttcttctctgcattttttaatcagacttgcatgtccctcatgaagaaatcccattgtcggaacaagtcccacggtctttccttcttttttccatgctttaatttgttttcttgtttcttctactgtttttgttacctgcatagtttgctcctctttcttcagttacatttcactgatgtcctgattttataaactcagagatagcctcttttctgaaattcactttcctcttacttgcaatactgttaatcctattgcttctgctgacttctcagccttactcttccatgtcttttaataagccatgtttctcataattggttactctactgattttattctcttcatttacaaatacaactgcaggtttatgtgtacgtgcctcttccggctcatactgtgcatatgccatgataataatcttatcacctgtacttacacatcttgctgctgctccattcagacagatcataccgctcccgcgttccccgcttatggtgtatgtctcgaatctgctgccattgtttacatctacaatctggactttttcatattccagtatgtttgcagcttcaagcagttcttcatccacagtaatacttcctacatagtccagttccgcctgaacaacggttgctctgtggatttttccttttaacatttctattgtcatcttatataatcctttcccataaggaaataaaaaaagcatttaaggacgcactccgaccccaaacacttctgattgatttcctgtatatccgagtcctgttttccttaaatacacaatacaggctcttatctttttatacttttgacatttacgtcataaattataaattctatataagattccagtgatttcagccagagtatagttttgagttcaaatactatctctggcgttattatcacatttaaagatttgtttgtcaagaggttcatttaggacgatagccccacaagtctacacagctagttgtaattccagaaaagccttctttaataataaaaatctcctgttcttctgattcatcaggagtatgttcagaatcagggttcatggaataagttggccagacttctttttttaagcaaaaaaatatgcgactaaaaaactatagttttcactataattctttaatcgcattccattcaccatacaatttattattttgttgttgtagagttttacaactctattatgattatgtacagataataccattttatttcatattagtcaattattctttatttatttattttttttgtgaacatttcacatttttctaattttacatttagcatttattacagatagctttagataaatttgaatgattatctccacactcctatcgttttttcaaaaaaatcttgaattgcctgctcatgttgtggatgaaaaatttcgggcagatttctttcgtcaaaaaatttcacctctacggtttcttcttgatctattttcacttctccgccaaccatctttcctctaaaaaaaatactacacatctgaatagtatcaccattttcgtatttatgaaaatatttgctgtaaactcctagcatatctataatagcaacatctactcctgtttcttcatgtacttctctgattgccgcctcttcagcagactctccgtaatctaacattcccccaggtattccccatttatttgaatctgatcttttttgcaataaaatttctcctgctttattctgtataattacacctgctgccattaacataattggcatgttccctactttatctcttaacattttccaatattccatacttgttctccttttatcttgcacaaataaaaagatgcgattaacaaacagtttcctcaactgtttttcttaatcgcatcttgtactcttcgcctaaaaatattttgttgttttttcttaacttaaattataacttcttatttaactgattgcaatattttcttttagaaaaagtcagggctttttttacgaaaactcagtttcagtattttattttttgaactaggtattttgcccaatcaaccttttttagttacaacacactaataatctacattttcggctgatatctcatattcgatacattatataccgtcacaaatgcttttggatcttctcgattaataaagttcatcaatttttgatattctgtcttatctacaattgtgataatttcatttcttttttgcatcttatatgcaccggtcgcctcgtagatagttgctccactatgcaaatcttcaataataaatctacgtaactcttcttctttgtttgtaatcacacaaactcgacgcttgatattatgatcaaagataaaatgatctaacaccattccattaaaataagttcccagaatacttaaaactactgtttttttatcatacactaacgcagctgaaagtgctacgcacattccggataaagacattgcccttccaagttccatattcagatacttattcataatttttgctacaatatcaagtccaccggaagaggcatttcgattaaataaaatgctaagtcctatgcttaccactaaaatataacaaaggacatctaattcctgactattggtcatcgaaccgaaatttggcgcaattttttcaaacaagccaataaacagcggtaagacaacactggtataaaccgtctttgctccaaattctcgaccacaagtgaaaaagccaattatcaagagcactacatttaaaatcattgtaatggcagataacggcaatggcacaaagtttgatattacaattccaagaccggaaatactactcactgaggtgtgacttggcactaaaaagaaataaaccgctgctgcaataatggcaactgcccaggttaaaatgatgatttcttttataaaatttttgtaatttaatttttctttcatagcttctttgttcctccaataatcaaaactcgaatcctcaaaataatacccaacagaaaaaccccggaaaccttatggttccggagtatcttacgtttgggcacaacattatcttgcgataacagatctatattcagtagtcgactaaactcaaactgcgtcttatgacttgctttcgttaagttctctgcctaattactcgatgattatagcaacacgacctgctcctacaatacgtccaccttcacgtttgtgaggttcttaaaatctcattattttctgtgattttcgtgtctttattgtcctgtgttataggatttctacgctatatttctgttctcttcattttttagtatcaaaacggtatcacagccagattttcatgagctgtcaactttccggttgcagattcccaccttgactgttataatcgaaacatgggtgctatcataacggtaggcggttagtccttcagcagagggactgtgaccctctgattacatagaaactcgaaagagaatccactggaaaggagggctaagccaatgagtattgtggactttattgcagtcgtgagcttcggcatcacctgcttttgtgccggatacacattcggcaaagataataacaagacacaaaaataaccgccccagcctcgcaaactgaacggttatttttaatcaattaagtatgtggactaaccgtctatcggtagcactctttttctataatcatattagcacgcatgtgtgaaaatgtcaaaaaatttcttcattcttggttattaatctccttgatcaactgtactgccttctctgcatcatcggttttcacgaatatatccacaccatatattccaaatcctggtgccccatgcattgcaacattcgcacctgcttcctgcgaaaaagctgctattccattttgctttaacatttctacaagttgttctgtctctactatattctgtgcattataaatttttgtccattctgccttagatatggaagtttcctttttctcctgaatatttgacgaattctggtttctttttcgattaataaatgccaagagcctaagaacaataaatgccacaatagtaataccaatcagaaatcccaatgctaattgtgttacctgtgtttctgtagctcccattctaaataaacatatgccatagatgactgtaaaaattcctgtacatatcacactggtgagaaaatctcgccatatagtagcactttttggcaaacatttatcccatattccattatacaccataatagaggcgtacaggattcctcctaccaaagcagttgctgtctctcctaaaaccaagcgaatatccacagttaataacatctgaataataatcgctaacacgctaatcacaaacattgatgcaaatgcaagatttccagcctttaatgctttttgtttcacccatccttcatacaccacaactttgtccagtgtttctttcatctctttattcatagtctggctcctttctccatccaggagctctctcatctcaacatcgtaatattcagcaagttgaacaagtatactgagatctggcatatttattcctgtttcccatctggaaactgttcttgcagatacctcaaacttctcggcaagctgctcttgcgtaagattcttttctttacgacattgctttaaaaaagctccaatcttttttgtgtccatgtctctacctctcttccacttacagcttaccaatatgtatcaaaattaccacgacataaaacgagaatccgctaattttcaaccggacatcgtatgtctaaaacaaataaacggtattttcaccccaaaagcattctattcctctataaattaaccttctcttttatgtctatccataagtagcagaataaacataacaaaccatatcacccatgcaattaaacaaccgattcctatatgccaaatatctataatcattccagcaataaaaggaattgacataaacatcattctcttcccatatgccttacacatagcattttcatcatatttttttcgttcttctgctgatttcatattataaccagacaagaatttggatgcttgtccttttgacctataaaaccatattccaaataaaagcataatcactgccattgcaaagtcaaaaataatataaatatagaacatataatgccttcctttcagtcaattcctcaaaccagaaattattactttttgcatagtgtgttttctaaaatgataataaccacgacatcaactacaatgattcccaatgcaatatatacaaaaaatgcaggcaaaatattttcaagcaagcccataattaatacaagaattgctataatagacattccaactcccattgtcctgcataacttcttttcatcatattttttcttttcttcttttgaagctgtattatatccagaaataaaccagcttccgtgtccagaaagtaaaactatagaaagtacagcaaatattacaaagacaatccacactatccaatcagaacctgttgctaaatctgctaatttcaattatagacccctccctaaattccgtttttcttaattctaaaaatctgaaagttgtcttttaagatttcaatttcgttaaatcctctaaatacatttctgtataaccacattctgggcagactgcaactctaacatcatctatagttgtcgccttttgtttttcatctacacgaacaaccatcccatagccaccgccattaactttaagtcttaaatctaatttcatacttgctccacacttttcacatttcctcattgtttatacctccaaatcccgaatttgagaaaaagcccaaaggacttttaatgtcccttatgcttttctcttttctttcgctgttttagttcaaacattcgctgttcttccgcctcttttttctttcgttttttttctttacgctcctgtttgttctgttcctgttgtaatttcaacgcctgttgcgattttgtgccaatgccagtttccagcatctgcttttttgctgaacgctgcatccgtttcggatttctttttatatcctttacaatagcttcaacagccggactgaatttcaaaccgaaatagtatttttgaatatattcctgcacttcataatcttttggttctacgccaaatgttacctttgccacagataatttaccatcttcaatatgctcaaatatgcctacccaaaatggttcttcaaaatataccgtcaatcttccatttactctgtccataaaaatccctcctaaaatttattgaacaaagaatggacaacccggaggggcaggttacttaccctatttatataggacggccgggctacctaccggctctggcacatcaaagatgcacgttgcgtttttatctttgttttgataagtttcaatttaccttcactttattttaccatagtgctttctaaagttctattctaatatacaaaaatgtaaaaaagcgattttatccccctcgcaatcacacatatatcatgtttttcaatacaatttcttctgcactagcttttatattattcatcagcctgacccactccatctgatcctgtgcctttaattcttcagttacaccctgtttttctgtcatctgttccataagcgtttccacctgttctctagcttcctgatcagtctgattcagatgttcattcagctttccaatcaataacaaatactgataccttgctgatctgtgttcttttaagaactgctttcgtaacattccatattttccatatgtcggctcttcttctcttaaaaccagatccggcaaatagtaatctccatgcaatgtatagctcattccatttttttcatcataaaattgttttttcatagtctaaatctccaatcctttgtattttgttctatttttcttacgttgttggttttcaatctgactcttttgagtcgcccattccaactgtttcagaacgcttccctttggcatttgctccattcgccgtttttcttccagtgtcctctgttctttaatatcctgctgcaccacatcctctacagtttctgatcccaaaatacgcaccactctgtcatatctgtccgaaatctcttgtaaacgttgattatcatttaataattccccattttctttacgcacatcatctaactgcgtttggatatcatcacatttctccgtagatttttgatatttgtttttccagctttctatcgttttgttaagttctacaacctttccagctaatgcagcaatctgattcttcatcttgataaacaatggcttgattttattttctctgtaaggtactgcacgttcaaatgttcctgcctccggtaaaaacgtcttaatcattccatattcttttatttctttactggcattatccataatcggctgcagcacatctcgacgctcttccagactttttacttctttttctgcgtcctctgccctttgttctgcttcttgtttctccctgattgcctgttccttatcgtcttttaaaatctggatatctgctctgaattccgcaatttgtgctgtcagttcttcgttttctgcagttagatactctttctcctgctccagctcctgtacttccttttttcgctctttcttcttgaagttataaacatccaaatgttcctcatgagtacctttctgttcccattcaatgccatgctgttttgcaatctctgccaggacctttttttcatggttcatccactggttcaactctgtatcatgcttatttccaccttgaaatccaagactttttaatgcctgtttcaatgaaactctggtgtccattccttttcctttccaatcagtcacataaggaataaaatcaatatgtaaatgtggagtagactcatcctgatgtagataacacccaaatacccgtagcgctggattccgtttctggaagtcctttacatattcatccagcacttttacagccagatctccttctactgttccgacagccatatcttcacgatttccaatctggaaaatcacttcgtggaacagcttttcctgctttccctgacggattttttcatagtaatttataatctgccgatcctttctttttcccacattataccgttctacagaatcatcaaacaactctttatatacttctttcagattttcattctggtaacggatattcaggtgtactctgtccggatctacattttcagctataaaatcccgtctgttatgagctagggaaccagctccaatcatgccgcttattgtcctttttattgtcatattccttcacctccccttctaaaagcagtgccagatattgcatataatctttatttacgccagccatggcaattataagaaatcttcgccggatacggcggttttgttacttttgtcaaaagtaacgcaaaagcactttcgacagccgtaccgtccatcaaaagtaaccttgcgccctgccgggggctatttctcctgcggtatgtatccgcatatcctattccggtattctcgcccggatatattccagatcaccacagtacggtgttcctaccagataccattcccttgccggattcatctccattctggtctgcacccactgatcatcaattagtacttccaggcattctccacaatgaaatcctgtatcaatccataaatctgatgacaataaaccatatctgtcgttactgctgttataacctaatcttccttctctcattgctgtatgctcctttctattgtcctgctgtaagcacgctctgctttagggctccctttcgcaacctataatttgtctataaataatcgggtaatctataacctctcgtctgcacattacagactttcccttgtctgatatttacaggtgcgtgacacgctcctgttatagagtaatcaacaagaagttttaccatcgaaagctttccggtattccctttttttccagatattcctgccggtacttttctctttcttcctctgttgctgctgttttgtacttgctgtataattctcgatttatcattgtatccagctttttttccaatcctttttttatatcatcctcttcctgtttctgatccagtaaatgatattttaaaagttttccaaacaactcctctggaaccataacgtttttcattttctcaccttcttacttttcagataaggacgcaacactgcaatgtctttacagattgcaaccttgcattttaattccgcattttctatatactctgcaatgttgcacccttaatttattccggcttaactttatttaaatcccaataccaggaattaccgattcgtcttgccttaattccaagttccttttttgcattttccagtgttcttttagaaatattcaaatcttctgccatatcaaagatttcactgctttgcacagaagttgatgtttctgccagttccctcagcatcttttttgcctgttccagtttatttacctttggagcaattccaccaagcacctcatctgctgtgatttcatagtcacctatccactcaaatccggtttctgtcaggcgaaatgctttggaatgtccaaatgcagccagattatttttaatctgaaccactgctcttaagtccggttctccctctattcttcctaccagtaatacgcttctggctactgcaaaaaagtcaatcgaacccattcctctatatgcagctttatttccaccagctttattcatatgtccgattaataaaattgcacatttatacttttctgccagcaagctcaatctttttgtcatatcccttgcttcatttgcccggttcatatccattgttcctccaaggtatgcctgaatcggatctaaaataagcactctcgcaccagtccgtttgatagcagtttccagtctctcatctatcatggaaagtgatttttctgtttcatctataaccatgattctttcacagaccgcttctgccagctccagtctgggttttaccgtatctgccagcccatcttccgctgtctgataaataatctttactggttctgttactttcatatcgttatccagaccttctcctttagacaatctcgctgcaatatttaatatcagcgtagtttttccatcgcccggatcaccctgaatgatcgttaatttcccataagggataaatggataccagagccagtccactgtctgggactggacatctgacatctttatcattttcaattctgttttattctcatttctctgttccataaattcctccatttttcaaactattctcgccaattatctgttgttctctggaagaatccctgatataatcaacttgtctagggttgacatttgtggattcgtccccatttgtcacattgctccggttgttcgtacttccggagctttttatattttcatcatccagcatatctgccaccactttctgctgatctggatataagtgcccataagtattcaatgtaatgcgaatgtccgtatgtccaaacctttctttaatcatcaatggttgcactcccttattgatcagaaatgccgcatgactgtgacgaatgtcgtgtactcttatcttttttactccggtcttttgaaccacctgttttaacttatgctgtaccgcttcatgaaccattggaaaaatccgttcatcttcgggcaactcatacagtctgctaatatagtcctgaatctcttttttcagaaattccggtatggaaatcgtacggttcgattcttctgttttgggagatgtaatcacgtcctctccatgcatacggtagtaagttttattgatatgaagtagattcttttcaaaatcaatgtcagcaggtgtaatgctgagtgcttcgccttctctcgctcctgtccagaataataattcaaacagcacataatatttgcttcccggttctattccggtcataaactgccgatattcttcaattgtccaaaacttcattttcttttttgaagtctttcccatacgttttactttgtcacaaggattatctgccagattgtagatattcttcgcatgattaaacaatgccgtcatctgattctgtattgttttcagataatcatctgaatatcctttttcaataatcgtattctgccactggataatctctgctggtgtgatactgttcatcggtctgtccttaaaatacggtaacagttgagcattcatcgtatctcttttgttcttgatactcctgtccttcaatgactgagacttgtctcggaagtagacttctacaaactctcccattgtcatatccatgtctgctttcgctgttcttttatactccgcttcaaaatttaatgcttctttcttagtgcggaatcctctttttacttttcgctttttggctcctgtccagtcctcataataaaatgaaacataccaggttcctctttcttcatctttgtatgctgccatactttctcacccccttacattgcaatctgggaatatccataaaatttcttttcccagaatgccctcggtatcttgcccgcaacggttacatatccctgatctgcaagctctttgttcagtttgcgaagcagcttgtaagcatatccaagtgaaatccccatgctctctgcaacttcttccgctgtaatcatatagttctgtctctgcatatcatttcctccttgtctataattatcattttcactgatactatatcattttaaataatcattgtcaataatttttatcatcatgaatgatatttttctatattgttgatttttatcatttgtgatatactaatcatagcttttaaggaggtggataatatgcaggaatcatctatttcagaaaaaataaaagagctgcgaactgatctgaagatgaatcaaaaaaacttttccgcagctattggtatacgtcagtcaactttatccagttatgaaaatggtgtggttactccctccaatgatgtgttattgactattgctcagaaatttcatgtctcactggactggttatttggattatctgaaaataaagtacagatttctactctcagcgatattctttgggttttactgcagatgaatgaatccaatgaactccggtatgaactggatataaataataaacttcccggtgatatagaaacagaaacacagaaatggtatgccggacttcgcttttatggaaatgatcctgaacattctttaaacgcagatatgtgtaattttcttgctgatctgcaggagaacagagaaagcctggaatcttatttcacaggcaaagatatgtttgatatgtggaaaaagcagacgttggaatactacacttccaaacctgtcacccataaagaaattgaagaactggattttgagacacgaatccgtaaacgagatgaacttttaacacagaaattttccaataacgaacagaaatagtatcataacagtatcacaggcagatatgcgaagattttcattttcttcccatacctgcctgtttttaatttattcgctattctttacagccttattttaaactttttactcaacagaaaaaccccggaaaccttacggttccggggtatcttacgtttggacacatgtaccttgcggtactcaatatatattagtcagtgattactcgatgattgtagcaacacgtcctgatcctacagtacgtccaccttcacggatagcgaatgtaagaccctggctcatagcgattgggtgaatcagttcgattgtcatttctacgttatcaccaggcatgcacatttctgtaccttctggtaagttacaaacacctgttacgtctgttgttctgaagtagaactgtggacgatagttgttgaagaacggtgtatgacgaccaccttcatcttttgtcagaacgtaaacctgagctgtgaattttgtatggcatgtgattgttcctggtttagcaagaacctgtcctctttcgatttcgtttctctgaacaccacgaagaagtgcaccgatgttatcaccagcctgagcttcgtctaacagtttacggaacatttcgataccagttacaacaactttacgtgtttcttctttcagaccaacgatttcaacttcttcagatacgtgaagaacaccagcttctactctaccagtagcaactgtaccacgacctgtgatagagaatacgtcttctacaggcatgatgaatggtttgtctgtgtcacgctgtgggtctggaatgtagctatctacagcatccataagttccatgattttgtcgccccattcgcttgctggatcttccagagctttcagagcagaacctttgatgattggagtatcatcgcctgggaaatcatattcgtctaacagttcacgaacttccatttctaccagttcaagaagttcttcgtcatcaaccatatcacatttgttcaggaatacaacgatgtaaggaacacctacctgacgagacagaaggatatgttcttttgtctgagccataacaccatcagttgcagctacaactaagatagcaccatccatctgagcagcacctgtgatcatgtttttaacgtaatcggcatgtcctgggcagtcaacgtgtgcatagtgacgatgttctgtttcatattcaacgtgtgctgtagaaattgtgataccacgttctctttcttctggagctttatcaatgttctcgaaatctgtagctgagttaccagcaactctttcagccagaacttttgtgattgcagctgttaatgttgttttaccatggtcaacgtgtccgatggtaccaatgttacaatgcggtttgcttctttcaaatttagcttttgccattttgaatgtcctccttgtttatgcgccccgtacgggcaatttttgtttgcttactgcctcattacgagacgtcggaatataccaatattatattaaaatatattcaacctgctatccttgattatattgcaaatcaaggatatttgcaagtttttttatcaataaatacgactgattattttgtagctttaccagcgagtactttttcctgtacggattttggtactggctcgtatttttcaaagaacatggagtagttaccacgaccctgtgttctggaacgcaggtctgttgcatatccgaacatttcggaaagcggaacatatccacgaatcattttaccaccgccgatatcgtccataccttcgatacgtccacgacgagagttaatatcaccaataacatcacccatgtaatcttccggtgttgttacttcgactttcatgattggctcaagaagcactggtgctgctttctgcatagcatctttgaatgctaaagaaccagcaatgtggaatgccatttcagaggagtcgacttcatggtaagaaccatcgtatacatttgcatgtacaccaacaactgggaatcctccaaggataccagctttcatagcttcttcgataccttcgcctactgccgggatgtattccttcggaatagcaccaccaacaactgtggattcaaacttgtacagttcttcaccgttggcatccataggctcgaatttaactttacagtgaccgtactgaccacgtccaccggactgttttgcatatttgctgtcaacgtcaactgcttttgtgatggtttctttgtaagcaacctgaggagcaccaacgttagcttctactttgaattcacgaagcagacggtcaacgatgatatccagatgaagctcacccataccagcgataattgtctgaccagtttcctgatctgtatgagcacggaatgtcgggtcttcttcagcaagttttactaaagcttcacccagtttaccctgaccagcttttgtcttaggctcgatagcaagctcgataactggttctgggaattccatggattccaggattaccggatgctgttcatcacagattgtatcacctgttgttgtgtttttgaaaccaacagcagctgcgatatcacctgaataaactttatcaagttcctgtctcttgttagcgtgcatctgaaggatacgaccaacacgctcttttttaccttttgtagcgttcagtacgtaagaaccggagttcattgtacctgaatatacacggaagaatgcaagcttaccaacgaatgggtcagccataatcttgaatgctaaagctgagaatggttcttcatcagaagaatgtctctcaatttcatttccgtccatatcaacacccttgatagccgggatgtctgtaggagctggcatgaattcaagaattgcatccagtaatttctgaacacctttgtttctgtatgcagaaccacagcaaaccggaacagctgcacattcacatgtaccttttctcagagctgcttttaatgcatcgatagaaggttcttcaccttcaaggtattccatcattaaatcatcgtctaattcacagattttttcgatgagttctgtatgatacagttctgcatcttcctgcatatcttcaggaatgtctgtgattgtgatatcctcacccttatcatcattgtagatgtaagctttcatttcgaataagtcgatgattcctttgaactcgtcttctttaccgattggtaactgaaggcaaattgcgtttttacctaaacgagtcttaatctgatctactgcattgtagaagtttgcacctaagatatccatcttattgatgaatgccatacgtggtacattgtaggtatctgcctgacgccatacattttcagactgaggctcaacgccgccttttgcacagaatacaccaactgcaccgtcaagtacacgtaaggaacgttcaacttctactgtgaagtctacgtgtcctggagtatcaatgatattgatacgatgttccagtgcacctggttttgctttacagttttcctgtaaagtccagtgacaagttgttgcggctgaagtaattgtgatacctctttcctgttcctgttccatccagtccatggtagcagtaccttcatgagtatcaccgattttatagttaacaccggtatagtataagatacgctctgtaagagtagtcttaccggcatcgatatgtgccataataccaatgtttctggttctctctaacggatattctcttccagccaatggattttcctcctattgaattagaatcgatagtgagcaaatgctttatttgcctcagccatcttatgcatgtcttctttcttcttaacagatgcgcctgtattgttcattgcatctaataattcatttgccagtctgtcttccattgttttctctcctcttttacgagagtagagagtaatccagcgaagagctaaagcctgacgtctttccggtctaacctcgattggtacctgatatgttgcaccaccgatacgtcttgcttttacttccagaacaggcataatgttgttcattgcttcttcgaatacttcgattgccggttttccggctttttcctcacatttagcgaatgcaccgtatacgattttctgagcaacacctttcttaccatctaacataatgttattgataagttttgttaccactttgtttccgtataacgggtcagctaaaacgtctcttttctgagtatgtcctttacgtggcacgttacttccctccttaatcattttcattgttaatagacaaatgacattgtcccaaagattaaatcatcggtactcacacaactataagcgtatgtccgtacgcggtaaattctctatataaacccgcagccactccgttgggcttatggaatccccgtacaaaatcaatagttatatctgtgatttcaaatgataatttctactataataaatcaagcggaaatttttaccgcctggccgaatttattattttttcggtcttttagcaccgtatttagaacgggcctgacgtctgtttgcaacgcctgcggtatctaatgtaccacggatgatgtggtatcttgtacctggtaagtcttttactctaccaccacggataagaacaacgctatgttcctgtaagttatgtccttcacctgggatatagcttgttacctcgattccgtttgagagacgaactctggcgatttttctaagagcagagttcggttttttaggtgtagcagttttaaccgctgtacacacacctcttttctgtggagaagacatatctgttgtcttcttctgtaaagagttgaagctcttctgcagtgccggagctgtagactttttaacggaagtctgacgtccttttcttactaactgattgaatgttggcattcctttcacctcctgtattatttttcttctgccatattatatagaagaaataagtggctgccagttattcattcttatgaataaactttttttatcgcgcacaaaaaatacgcagtcctgtgcacgcctcctcattatatctgtggaaaaagttgctgtcaaggtatttttttgttttttttatttttctttcaaaaatccgaccctcacactcatttatccgtctatgaaagagaaaaacaaaagactattttgccagttatctgacaaaacagtcttttgcatttattttcttactactcttactcttctgttaattctgcttcttcttcctcttcggaaagttctacttcatcaacagcatctgtaagtgtttcttctgtatcctctgtggtttcctcaccaactgttacgtcttcattttcttccatttcgtcaaactcaacttcttcttcatcagtatcaagcttaatattggaatactgtttcatacctgtaccagccggaatcagtttaccaatgataacattttctttcagaccaatcaacgggtcaatcttacctttgattgctgcttctgtcagaacttttgttgtttcctggaaggaagctgctgacaggaaggagtttgtagcaagagatgcttttgtaataccaagcataacctgttttccttctgccggttctttgccttcttcaatcagtctttcgttctcttcttcaaagtcaagaacgtcaactaatgttcccggaaggaattctgtatctccgttatcttcgatacgaatcttcttcagcatctgacgaacgataacttcgatatgtttatcattgatttctacaccctgcagacgatatactcgctgtacttcctgaatcatgtaatcctgaacggcacgtactcctttaatcttcagaatatcatgtggatttacagaaccttctgtcagttcatcacctgcttcaagtacctgtccatcctgaatcttaatacgggagccataaggaatcaggtaagtcttggagtttccatcttcgttgtctgtaacaatgatttcacgtttcttcttggtatctttaatggtagcaatacctttgatttctgtgataatcgcaagaccttttggctttcttgcttcaaaaagctcctcgacacgaggaagaccctgtgtaatatctccaccggcaacaccaccgttatggaaggtacgcatggtcagctgtgtaccaggttcaccgatagactgagcagcaatgatacctacagattcaccaacctgtactgcttcacctgttgccatgtttgcaccatagcattttgcgcagacaccaatatgacatttacaggtaagaatggtacggatttttactgcatcgtagccagttccatctgcttttacaccgtcatttacgattcttgcagcacgttttggtgtaatcatatgatttgcttttacgattacttcaccatttttatctttaattgtctcacaggagaaacgacctgtgatacgttcctgaagactttcgatttcttctcttccatccatgaaggcttttacccacatacccggaatttcgtttctgttttcactacagtcaacttcacgaacgattaagtcctgagaaacatctaccagacgtcttgtcaggtaaccggaatcggctgtacgaagagcagtatcggacataccttttcgagccccatgcgctgacatgaagtattccagtacatcaagaccttcacggaagtttgatttgataggcaactcgattgtatgaccggttgtatcagccatcagaccacgcataccggcaagctgtttaatctgcttgtcagaaccacgggctccggagtcagccatcataaagatgttgttgtacttatccagaccggacagcagtacacgtgtcagctcatcatcggtctttttccatgtttcaacaacttctttgtatctttcttcttctgtgataagaccacgtttgaagttctttgtaattaagtctacggtatcctgtgctttctgaatcatttccggtttctgaggcggcacagtcatatcagaaattgatacggtcatcgcagctcttgttgaatatttataaccggttgctttaatcttatccagcacttctgctgttcttgtagcaccgtgtgtattgataactttttcaagaatctgttttaactgtttcttacctaccaggaagtcaacttccggttttaattcatttcccggaattgtacggtctacaaaacctaaatcctgaggaatgatttcattaaataagaaacgtccaagtgtagattctactgtaccggaaagaacagttccatccggcattgttttttccatgtgtacatggatttttgtctgaagcgtaataacctggttttcataagccagaattgcttcgtttacgctcttgaagtattttccttctcccttaacaccaggtctttcctgtgtcagataataaataccaagaaccatatcctgtgaaggaacggctaccggaccaccatcggatggttttaacaggttgtttggtgagagaagcaggaaacggcactctgcctgtgcttcaacggacagtggaagatgaaccgccatctggtcaccatcgaaatcggcgttgaatgcagtacaaacaagcggatgtagcttgatagccttaccttctacaaggattggctcgaatgcctgaataccaagacggtgcagtgtaggggcacggtttaacataaccggatgctctttaattacttcttcgagaacgtcccatacttccgggtcgagtttctctaccatctttttcgcatttttaatattatgtgcatttccgttgcttaccagttctttcataacgaaaggtttaaacagctcgattgccatttcttttggcagaccacactgataaatcttcagttccggtcctacaacgataactgaacgtcctgagtagtcaacacgtttacccagaaggttctgacggaaacgtcctgatttacctttgagcatatcagaaagggatttcaatgctctgtttccaggtcctgttaccggacgaccacgacgtccattatcaatcagagcatcgactgcttcctgtaacattctcttttcattacgaacgataatgtcaggagctccgagttcaagcagtcttttcagacggttattacggttgataattcttctgtacaggtcatttaaatcagatgttgcaaaacgtccgccgtcaagctgaaccattggacgtaagtctggcggaataaccggaacaactgtcataatcatccattccggacgatttcctgattctttaaatgcttctacaacttcaagacgttttacgatacgtgcacgtttctgacctgttgaatcttttaaacctgcttttaattctgctgattctttttcaaggtcaattgcttcaagcagttctttgatggattctgcacccatacctacacggaatgcagaataaccatattttgcacaagcttcctgatactctttttctgtcagtatctgtttatactgaagctctgtttttcctgcatcaagaacgatgtagcttgcaaaatacagaactttttccagagaccttggtgaaaggtcaagaatcagccccattctggatgggattcccttgaagtaccagatatgggataccggagctgcaagctcgatatgtcccatacgttcacgacgtacacttgcttttgtaacttcaacgccgcatcggtcacaaacaacgcctttatagcgaattttcttatatttaccgcaatgacattcccagtctttgcttggtccaaagattttctcgcagaaaagaccgtctttttccggtttcaaggttctataattaatagtttccggttttttaacctcgcctcttgaccattcccgaattttttcaggggatgccaaaccgattttaatagcatcaaaggtcattggctggtatacctctttatttgctgtttctggcattgtggactcctttccttactcttccagagtatcctcatctacgctcagtaaatcatcgtcattgtcttcttcttccacatcgactaattcttcaccttcaaattcctgtttctggaatccgtagttgccgtaatcttcgtcatctctgtggtgtctggaatcaccttcgataatagaacgcatatcagtctcgccataatcgatattttccatgatttccacttctgtcatatcatcttttaagactctgacatccagacccaaggactgtaattctttgagaagtactttgaatgattccggaataccaggctccggaatattctcgcccttaataatcgcttcataagtcttaacacgtccgattacatcatcggattttacagtcagaatttcctgcagagtataggaagcaccataagcttcaagtgcccaaacctccatctctccgaaacgctgaccaccaaactgagctttaccacccagcggctgctgtgttaccagtgagtatggaccggtagaacgtgcatgaatcttatcgtctaccaggtgatgcagtttcaggtaatgcatgtgtccgattgttacagggctgtcgaagtattcacctgtacgaccgtcacgaagtcttactttaccatcactggaaatcggaacacctttccacagttttctgtgttctctgttgtctgacagatactgcattacttccggatttaatgtatctttatgttttgcctcaaactcatcccattccatgtttacatagtcatttgcaagtctgagggtatcctgaatatcaacctcgtttgcaccgtcgaataccggtgttgcaatgttaaatccaagtgcttttgccgcaagacttaaatgaatctcgaggacctgtccgatattcattcgggaaggtacacccagaggattcagtacgatatccagcggacgaccgtttggtaagaatggcatatcttctacaggaaggacacgggaaacaacacccttgttaccgtgacgtccggccatcttatcaccaacggaaatttttctcttctgagcaatataaatacgtactgcctgatttacaccaggagacagttcgtcaccattttctcttgtaaatacttttgcatctacgataataccgtattcaccatgcggtacttttaaggaagtatcacgaacttcacgtgctttttcaccgaaaatcgcacgaagcagcctttcttctgctgtcagttctgtttctccttttggagttactttaccaacaagaatatctccggcacgtacttctgcaccgatacggatgataccacgttcatccaaatcttttaatgcatcatcaccaacgcctggaacgtctcttgtgatttcttccggtccgagttttgtatctctggcttctgcttcatattcttcgatatgaacagaagtataaacgtcatcctgaaccagtctttcactaagcagaacggcatcctcgtagttataaccttcccaggtcatgaatccgattaatggattcttacctaatgcaagttcaccatttgatgtagaagggccatctgcaataacctgtccggcttctactctctcacctttgaacacaatcggtctctggttgtaacagttactctggttactacgcataaattttgtcagatgataaacgtctttctttccatcatctgtacggataatgatttctttggaagctgcacactctacaacaccggaattttttgcaacaacgcagacaccggagtcaactgctgcttttgcttccataccggtacctactacaggagcttctgttgtaagaagcggaacggcctgacgctgcatgttggaacccatcagcgcacggttcgcatcatcgttctgtaagaacggaatcagcgctgtagcaacggagaataccatcttaggagatacgtccatgtaatcaaacatatggcgttcatattcctgagtttcttctctgtaacgaccggatacgtttttatgaatgaaatgaccctctgcatccaacggctcattcgcctgtgctacatggtaattatcttcttcgtcagctgtcatataaacaacttcatctgtaacacgaggatttttcggatcagatttatcgattttacgatatggagcctcaacgaatccataattattaattcttgcataagatgcaagggagttaatcagaccgatgttcggaccttcaggggtttcaatcgggcacattcttccataatgagaatagtgaacgtctcgaacctcgaaacctgcacggtcacgggacagaccaccaggaccaagtgcggataaacgtctcttatgagttaactcaccaagagggttgttctgatccatgaactgtgacagctgggaagaaccgaaaaattctttcactgctgcagttaccggtttgatattgattaaggactgcggagaaattgtatcgctgtcctgtgttgtcattctttcacgaacgactctttccagtctggaaagaccgattctgtactggttctgaagtaattcaccaactgcacggatacgtctgtttcctaagtggtcaatatcatcatcatttcccagaccatattccagatgcatattgtagttgatagaagcaaaaatgtcttcttttgtaatatgcttcggaattaattcatgaatatcacggcggattgcttctttgatatcttcaatgtcttcattttcttccagaatcttagccagtaccggatagtaaaccatctcggaaacaccaacttcttccgggtcaatatcaacaaagcttgtgaggtctaccatcatactggacagtactttgattttacgctcttcgccctgaatccatacgaaaggaacagctgcattctgaatctggtcagccagtgcttttgttacaactgtacctgtttctgcaataatttcacctgttgtgacatctacaacttcttcagccagcggatgccctacaatacggtttcttaataacagttttttgttaaatttataacgacctacttttgccaggtcataacgtcttgcgtcaaagaacatgccattaatcagactctctgcgctgtctactgcaagcggttcacctggacgaattttcttatacagttctaaaagacctgtatgataatcctcagatgtatctttaccaaaacttgcaagaatctttggttcttcaccgaataaatctataatttctgcatttgtacctacacctaaagcacgaatgagaactgtaatcgggacttttcttgttctgtctacacgaacatagaacacgtcattggaatccgtctcatattccagccatgcacccctgttcggaataactgtagcagaatacaaggtcttacccagtttatcatgagcgattgcgtagtagatgcctggagaacgaaccaactggctgacaattactcgttcagcaccgttaattacaaacgttcctgtagcagtcatcagtggtaaatcacccataaaaatctcgtgttcactgacttcgtcattttctttgttgtataatcttacctttacttttaaaggtgcagcataagtcgcatctctttctttacactcttcgatggagtattttacttcatcttcgcataaagtaaagtcaacaaattccaagcttaacttaccgctataatctgcgattggagagatatcttcaaaaacttcattaagaccttcgtccaaaaaccactgataagagtctttctgaacttcaatcagattcggcatttccagtacctctttctggcgctggtaagtcattctcatgctcttaccggatttaatgggacggattctgtttttctccattgacgtttcaccccttgtatgttttaattttattatggattatgattcagatcctgttttcttcctgtaaatttataaataaatagaataacaggcataagtttccataatagtgcatttttcactttatcacattctataatgcatgtcaagcattttttcaactaaattttttcattaaaatttttcattcttggataaacaaaaccccgacatccaaagatgtcggggtcaaaagttctggcaagtttacacttaaattatttaagagtaactttagcgccttcgccttcaagttttgttttgatttcttcagcttctgctttagatgcgccttctttaacaactttaggagctccgtcaacaacttctttcgcttcttttaagcctaatccagttacttcacgaactactttgataactttaactttgttaggaccaacttctgtcagttctacgtcaaattcatctttttcttctgctgcgcctgctgcatctcctgctgctgcaactacaacacctgctgctgcggatacaccgaattcttcttcacaagcttttactaattcgtttaattctaatacagataattctttgatagcttcaataaattctgctgttgttaattttgccattttaaatttacctccattttttcgtttttcaattttagagtaccggataaccggtcatatttcttattttctaccgcacattattctgctgctgcgccaccctgctgttcagcaatctggttaagcacacgagcgaagtttgtaatcggagactggatacttccaagcaattttccaagaagttcttctcttgatggtacttttgcaagagcttcgattccagctttatcatagtaagtgtcttcaacaacacctgctactaattccagagtcggaacgtcttttgcatatttagcaagaattcttgccggtgcagttgcgtcttctgcgcatactgctaatgcatttgttccttctaagtgctggcataattcttcacaaggagttcctttgaatgcaaagttcatcattgtgtttttgtatactttataagtaacaccagcttctcttaattccttacgcatctttgtatcctgttcaacagtgatacctttgtagctaactaatactacgcttgctgcaccattgatgctgttagcgatttcttctacgacaggctttttaagttctacttttgccatgaattagtgcacctccttatttttttaggctgcgctgctcctttacgaaaggtacttcaatattagtacttacaaaaagacctctccgcacaagacagagaggttttatcaatcctaaactttgtaagaatgaatctttcctcggcaggcgttttaaccttatgcctaacggcacctgctgtcttcggcagctattcctctagcagaataccaaacctatagaggtttgtcaagaactttttttatttttttattttacaacacaaaaaagacgccatatctctcttgcttagatacgacgtctttttctaaaatctattactgagctaattttaccgggttaaccttaacacttggtcccattgtagaagcaagtgttacactcttcaggtactgacctttcagtgtgcttggtttagcctttgcaatagctcccataagagtctggaagttgtctgctaactgctcctctgtgaaagaagcttttccgattggcacgtgaatgatgtttgttttatcaagacgatattcaatcttaccagctttgatttcctgaacagcttttgttacgtccattgttactgtaccagcttttgggtttggcattaagccttttggtccaagtacacgacccagacgaccaacaacacccatcatatccggtgtagctactactacgtcgaaatctaaccatccttcgttctggatcttcggaattaattcttcagctcctacgaagtctgctcctgctgcctgtgcttcatcagcttttgcatttttagcaaatactaatacacgaacagttttacctgttccgtgaggaagtacaactgcaccacgaatctgctggtcagcatgacgtccgtcacatcctgttctgatatgcgcttcgattgtttcgtcaaatttagctaccgctgttttcttaactaaagagatagcttcttctgtttcatataaatttgcgcgatccactgcttttgcagcttctacatatttctttccgcgtttcatattaataacctcctagtggtaattgcgggaatgtccctcccacgttcgtttgatagttaattactcttctacagtgattcccatacttcttgcagtaccagcgatcatgctcatagctgcttcaagagaacctgcatttaagtctggcattttcatttctgcaatttcctggatttttgctttggaaattgtagcaacttttgttttgttaggaacgcctgaaccagatttgatgttacaagctttctttaacagaactgctgccggcggagtctttgtgatgaagctgaagcttctgtccgcatatacagtaataacaacagggatgattaagtcacctttatctgctgttcttgcattaaattcctttgtaaactgtacaatgtttacaccgtgctgacccagagcaggaccaaccggtggtgctggtgttgcctttccagctggaatctgtaatttaatatatcctgttactttctttgccattttggcacctcctaataatgtggtaatgtcggggatttccctcccacgggcctgtgacctacggcccttttacttttgttacaatttctttacttccgcgaatccgatttccaacggtgtttcgcgtcccatcatctcaacatttattgttaccgtacgttttgcttcgttgatgctctggattacactctctgtgtctttccatgcaccacttgtgataacaacgctgtcacccacttcaaaatcaatctgaactactacgttctgaattccaagacgttccatctcagcttctgagagagcaaccggcttggaacccggacctacgaaccctgtaacacctctggtgtttcttacaacataccatgtgtcatcattcattaccatgtgaattaaaacgtatccagggaacatttttttctgaacaattctacgtttgccatctttgttctcttctacgtcctctaagggtacgcgaacttctaaaatttgattttccaggtgtcggttctcaattgtcttatcaatgttggcttttaccttgttttcataccctgaataggtatgtacaacataccaatttgcttctgacatgctttcaccttatccttacttaatcaataaattcaatgcctgcagagctgcactgtcaactgctgaaataagtacacctataatcgcagtaataactacaacagcaacggtctgttttaccagtgtctgctgttccggccagactatctttttaaattcagcctgaagtcctttggtccagcttttctttggagcttttccttttttctctgcttccatagcttcacctcacagccagattattttgtttctttgtgcaaagtatgagccttacagaacttacagtactttttagtttccatacgttccggatggttctttttctcttttgtcatgttgtaattacgctgtttacattctgtgcatgccaatgtgatttttacgcgcacgacttccacctccatgtgtcttttatcgccggcagattcacgtttctgcctttgcaacgtttccttgtttaccgcgacaaatctttttttatcctttgttttaggcacaaaaaaaagacccacttccactgtcgcttttccagtctaacatagatgcaggtctttgtcaattactttattttcttttaacactcatatcgtttatcgttttttatattccgtaattgtttcacggattttgttgtaatccttacatacttcctctacctgttctgcatctggcataacctttctggaacgcaaagcctctgtcaatacagaacttgattctgcaagattatcaaatcccatgttctgtgcaacaccttttaaagtatgcgccgcacgaaacgcagcttccagatcttcctcctccagcgcttttttcagattttcaaaacttggatcttcttcaaatttaaataaaaatttttctactaatttttcattatacagacgccttacggtatcttcataattaccgcctaatgcatcataacactcttttaatgtcatttttttccattctccttaaagtcaaattattttattattctattttttaatactttttgccccatacttttgttcgttactagtaacataaaatactttatcttatttgtcaagtttcttttctctgaaaaaaagaaaaggaaaaacgaaattttcttttctcgtttcccttttctcattcgtgctgattagtcgtcgattccgacgataacagaagttgctttgctgactactcccacaggcaagcctatgaagtttcgccactaaattataacttttatcaatcagatttttcactcaagaagcatgagagactttttcggaaacaccatataagatggtaatggttgttccgttgtctcttttaaatccggtttttcttcgatataccaaagtctcttgctctttggattttcagcatttttaaacaaatgctgattctcaaacggagtctctgtataaccggccgatacaattttcatggaatttattttttccggcacgtctgacggtttcatatagtgtgcccgaatcccaatatattttatggaatcttttacttcttcttccgtttcaaatacaaaatcccagtccctggcatacacactgtgactgcctcttttttctgccgcagaaatatttttacagccggtcaatctcgctgcttccatctttctcggatttgcaaaaatatcggttgtctttccttttaagatacagctgcctttttcaagcagtaccatattgtcacaaaaacgatagatttcatcccttgaatgagaaaccatcagtacatccttttggtattcttcaatcaattccagcatttcaagctgaagcgtatcttttaaaaatccatcgagcgcagaaaatggttcatccaacataattatttccggctgatggagcaacattcttgcaagtgcaaccctctgctgttgtccgccggacagctgggaaggatatcttttttccaaacccgaaagttcaaaacgttcaagctgctcttttatcttcgcccgtttttcttcttttttgccctccattacaaccatcagattctgttctacggtcatagtcggaaataaggcataattttgaaataaatatccgacatttcttttctgaaccggaagattaattttcttctcggaatcaaacaatactcttccatttaatacaattcttccgctgtccggtttttcaattccggcaatacattttaaggtcatgctctttccacagcccgacgcgccgaggattcccatgcatccctcttttgtttcaaattccacatccaatgtaaatccggaaaattttttctttatctttgcctgtagtgccatatcacatccacctgttcacatttttcatattttttcctgatatcagattgatgagtgccacaatcaggaacgataaaattacaatcacacagacccaaaatgcagcggtatcccagtttcctgcggcgacctccgaagcaattgccacggataccgttctggtttttccaagaatatttccagcaagcatggaagttgccccatattctccaattgctcttgcaaatgcaagtaccgtaccggatgcaagtcccggagctgccatcggaacaactaccttccagaaaatttttctctcagacattccaagcgttctccccgcataaatcacatttacgtcaatctgttcaaatgctgctcttgcatttcgatacataagtggaaatgcaatgacaagtgccgcaatcacacagcccggccaggtctgaaccagcttaatgtcaaactgtgtgtataaatactttccaaatggtctccgcagactgaaaatcagtaacagaaagaaacctgctaccgtaggcggaagtaccagtggaagtgtcaataatccatctacaactgcttttgcggtattgtttaatttcataataaaccttgcggctgcaattcctgcaaaaaacgcaagcacagtcgcaagaatacctgttttcagagaaataaaaagaggactccaatctattgtctccaaaatttcagccatagatcttcacccccttttgttcttatttactttttattcttctgtatactgtttaaatcctgcttctgttaataattccatcgaagatggatctgttgcaacatattttttaaattcttctgctgcttttacttctgcatcacttgcttctttatcttcaattaatccaatcggatagatagccgggtcaacctggtctgcagttgcttccgcaattacttcaactttatctgccatagaagctgcatctgttgcatatacaacaccaacttcgttgcttccttctgctaccgctgtaagcactgctgtaacatttgcaccttcgttgatttccatcgccattacatcatcaagatttccgatgttttcaaacaattttcttgcatactgtccaaccggaacatcttcacctgcaagtgcaaggctggaagcctctgtaatattatcaaatcctgtaactgctgtttcttctccggttggtttaattaatacgattttattttccagtaaatttgtcacagaaccatcgattacataaccttcttcagttaaagcatccatctgctttgtagctgccgagaagaaaatgtcgcactgtgcgccttcttcaatctgagtctgaagagttcctgaactatctgcattgtagataatgtttacattcggatgctccgcctcataatttgctttaatttcttccattgtgttctttaagctggctgcgataaacacataaacatctgtcttttcgccggaagcctctgtctcatctgctgcatcagcttcttctttgtctgtctcatccgctgctgcatcttcttttgtgtcttttgcactgctgtcaccagaatcactgcttcctgagccacagcctgcaagcatggttgcaccaagtgtcatagacagtaaaagtgccatcatttttctcttcatatttgttttcttccttcataataactataatttttatggttatattttagaaaacaattcggtcaatgtcaactaataccggcaataaattacaggttttctccatttttctaattacttcactataccagtatgcagaacctttttaaacatactgaaattcattatagtaactatatagtaactattttcttcgtgccctcagttcccttggtttacatccatacgtttcctgaaacatcttattaaataatttataattggtaaatccatgtttttcggttatatcaaggatattttctttggtactgcataaatcatgataaatgtgcatcaaccggatttgatttaaatattttgaaaatgtaacacccatattttctttaaaaaaacggctgaaatactcacggctcagataaaatcgtccggacacttcttctaatgacagtcgttctgtatgatgttcttcaatataatcggtaatctcagaaagcctctccagtcttgtgtcatcttcccgtaacgtaatcgcagtctttggataggaaaaagcgaataacagctttgacataatctgaagcgcaatcgcctgccgttccagccgatagccaagtggctgattgacataaagaggcggcaatttttttaacaggtcgcaaatctgaaaataatcttccagatttgttcttaataattcacttcttcggcagctgattctatacttttccagatttggttctatctgaatcatcgcacttcttgaaaaatgaatcactatcatcatggaagccctggcgcaccttgcttcatgaatctgattggaatccaccacaataaattctccggcaatcatcttatattcttttccttcgattaaaatggtaccgactccatttaaaatatacatcagttcaattgctccatgccagtgagccggtgtgtattctccctgattggtatgatacttgatattaataccatttttttccaattcaaacaaaggttcataaatcatattaacttctccaaattttgcacgccattgcgtgctttctttatttctgtcgacttccttccatttttgtatacaatgtcaatattaaccgaattaatagctaaaaactcatctaaacacttcatatctttcatgctattataacactcgtaaagaacaaagaacagtataaaaaaggagatgttaattatggcaagtactacagctacagctatggtaaaagcaaataaagaagttaaaaaagttacattatgggaacgttttaaaaactatttaattgaaaacgttgatatcattgcaccaggtattatcatgatgaatggcggaacctattttccaaaactgaaataataggctccgccttttttttatcctttaatctgccgttatttctgcctcctgcgtaccatttacattcaaagttttccaaatttagagcagcaaaaaagccctctgacaaaacttaaagttttgccagagggctttctaaaataaattttaattcgttttacaattagtcctcaattgtaactttgtccagatgccagatttcatccacgtactgctgaatggttctgtcagaggagaatttaccggagcatgctgtatttaagagtgctttcttagcccaacctgcttcatctctgtaagcttcttctactcttctttgtgcgtctgcataagatttgaagtcagctaaaataaagtaagtatctgcacggtcactgcagtttgtatttaataaggaatcatagatttcacggaacatttcaaagtcgccgtttgaataagtaccgttaatcaactgcattaatacatttctgatgtccgggtcattattaaagtactgcattgggtcatatccgccattattttcgtagttgataacttcatcagaagacagaccgaagataaatgcattttcttcgcctacttcttctacgatttcaacatttgcaccatccattgtaccaacggtaagtgcaccgtttaacatgaacttcatgttaccggttccggatgcttctttacttgctgtagaaatctgttcggaaacatcagctgcagcaaagatgatttcagcgttggatacacgatagttttcaataaatacaacttttaattttccgttgatggaagcgtcgttgttgatcacgtctgcaactgagttaatcagtttgattgtcagttttgcacgtctgtaaccagcggctgctttggcaccgaagataaaggttctcggataaaaatctctttccggatgttctttaatctgattgtacagatacataacatgcagaatgttcattaactgacgtttgtattcgtgaagtcgttttacctgaacatcaaagatggagttcgggtctacttcgattccgttatgctctaagatatattttgcaagacgcactttattctggtatttaatgttcataaattcctgctgtgctttcttgtcatcggcataaacttttaacttagcaagctgtggcaggtctgtaatccatttgtctccgatgtggtctgtaatccaatctgtcagaagcgggtttgcatgaaccatgaaacgtctctgagtaataccgtttgtcttattgttgaatttttccggatacatttcgtagaaatcttttaattcctgttttttcaggatttcggtatgcagtcttgcaacaccgtttacagaataaccacctgcaattgcaagatgtgccatcttaacctgtccatcataaataatagccattttgcggactttttcctgatttccaggatatttctggttgatttcttcgatgaatctgcggttgatttcttcgataatctggtaaactctaggaagcaatttggagaacagctcgattggccatttttccagtgcttctgccatgatggtatggtttgtgtaagcacaggtatgtgttgtgatatcccatgcatcatcccattcaagtttttcttcatccagaagaatacgcattaattcagcaactgtcattgtcggatgggtatcatttaactggaaggttactttcttcggcaggtcatgaatgtcgctgtgttttttcttgaattttgcgattgctgcctgaatacttgcagaaataaagaagtactgctgttttaaacgaagttctttacctgcatagtgattatcattcggatagagtacgtcacaaatattttttgcaaggttttctgcttctaccgcttttctgtaatcacctttatcaaataagtctaactggaattcattcattgcttctgcatcccagatacgaagagtgtttacaattttgttgttgtaaccaacgattggcatatcgtaaggtacggcacgtactgactgataaccttcctgaatgaagttgtttctgcctgtagccgggtcgtattctacacgaacatatccgccgaattttacttcttttgcatattccggacgacgaagttcaaatggatagccatctttcagccagttatccggaacttctacctgatatccgttttcgattttctgtttgaacagaccatagtggtaacggataccacatccataagcacagtatccaagtgttgcaagggagtctaagaagcaggctgcaagtcgtccaagaccaccattaccaagtgccggatccggctcctggtcttcaattgtatttaaatccagtcctaactcatcaagtgcttcttttacttctttgtatgcacacaggttgattaagttattaccaagtgcacgtcccattaagaactccatggaaagatagtacacaatcttcggatcatctttttcatactgtttctgtgtcaaaagccagttatcaataactacgtcttttaccgccagagaaactgcctggaaaatctgctcctgacttgcctcatccaaggtctttctataaagcatctttacattctcttttacacttttcttgaattcttcttttctgaaatgtgaatctaacatacttttcctcctctgattttttctgtgttttttcatctttttcttctcaaacatcccaaaacacaaaattatattaattatgggagtccccttcttcaagagactcccatagtaatatactgcatgcggcagaattattcggaaattttttctactcctaatgttactttttcagagttgattttccactctttgacatatccggctgtttctgtgtaaacaacatcttctgctaatacctcggatttgatatctgcttcgtgagcacggaaaatcccctcaattacatcattaccgcttaaggaaattttaatcttatccataacttcaaatccggcttctttacgcattgtctgtactttactaatgatttctcttacatatccctcttcaattaactccggagtcagatttgtgtcaagtactactgtgatgtcattgtctgattctgaaacgtacccctccatctgagcagtatcaataagtaaatcactctctaataatacaatctcttcaccagcaatgtcaagtttcagctcaccggttgccttaagttcatccattgctttatttccatctaattcagccagtgctgttttgattgcatttaagtgttttccatatttcggacctactgttctaagctgtggcttaaagctgtaggaagtaaattctcttacgtcatcggtaaatgccatctcttttacatttaactcatctttgatgatatcagtgtagaaatcagacagagtaaaggatgcctttacaaacatttttccaattggctgacggtttttgatatttgctgtatttctgcaggcacgtcccataaccacaatttccagaaggtcttccatgttttcttcgagttctttgtcaatccatgcttcatttacagcagggaaatcacaaagatggatactttccggagctgttttatcaatgcttcttaccagattctgataaatatcttctgtcataaacggaatcatcggtgcagctgcctttgcaactgttaccagtgcggtgtacagagtcatataggcattgattttatcctgttccattccttttgcccagaaacgttcacggcttctgcggacataccagttactcatatcatctacaaattcctgaagtgcacgtgctgtttccggaattttgtaatttgccagattgttgtctaccgtctgaactaaagtatttaacttagacagtaaccatttgtccatgacagcgagtttgtcatactctaatgtatattttgttgcgtcaaattcatcaatgtttgcatacagtacaaagaatgcataggtattccataaagtacccatgaatttacgctgtccttcctgtacggcttttccgtggaaacggtttggcagccatggagcactgtttacatagaaataccagcggattgcatctgcaccgtaagtttcgagtgcgtcaaacggatcaactgcatttcctttggatttactcatcttctgaccattttcatcctgtacgtgaccaagaacgataacattctgatatggtgctttattaaataataacgtagattctgcaagcagagagtagaaccatcctcttgtctggtcaactgcctcagaaataaactgtgccgggaactgcttttcaaatacttctttattttcaaatggatagtgatgctgtgcaaatggcattgctcctgaatcaaaccagcagtcaattacttccggtacacgatgcatggtctttccgcatttcgggcaaggcattgtgatttcatcaatatatggacgatgaagttctactgttttggctttttcgtcaccactgagtttgcagagttcttcacggcttccgacagactgcatacatccacattcacattcccagatatttaatggagttccccaataacggtttcttgaaataccccagtcctgtacgttttccagccagtcaccgaaacgaccttttccgatgctttccggaatccagttgatggtattgttattgcggattaagtcctcttttactgctgtcatcttgataaaccaggattctcttgcatagtagataagaggagtatcgcatctccagcagtgcggataatcatgctcgaatttcggagcatcgaataataaaccttttgcatccaggtcttttaatacttcagggtctgcactcttgacattcgggtctttttccatttctgctttagaaggttttgctctcattcctgcaaatggagtttctgctgtcatgcatcccttttcatctacgaatttaaccagcggaaggtcatattcacgacccacacgggcatcgtcttcaccaaatgccggtgcgatatgaacgataccggtaccatcggacatggttacataatcatcacagattacataatgtgctttcttatgctgtttttctgcttcttttgctgcacattcatacaatgcaacataagattttccttccagatctgttcctttataagtttccagtacttcgtaggccggtttgtcttcttccgctaattttccaagaactttatcaagcagagcttctgccatataataaacataaccgtcaactgattttactttacagtaagtatccgatggatttacacaaagtgcaacgtttgaaggcagagtccatggggttgtggtccatgcaaggaagtaagcatcttcacctactactttaaaacgaaccactgcggaacgttcttttactgttttataaccctgtgcaacttcctgagaagaaagtggtgttccacaacgagggcagtaaggtacaatcttaaatcctttgtaaagcaggtttttattccagatttcttttaatgcccaccactcggattcgatgtaattgtcgtcataagtaacatatggattttccatatcagcccagaaacctacggtagaggagaaatcttcccacattcctttgtatttccatacactttccttacactgctggataaacggctccataccataagcttcaatctgctcttttccatccagacccagtttcttttctacttccagttctacaggaagtccgtgggtatcccatccagcctttcttggaaccatatagcccttcattgtacgatatctcggaatcatatccttgataacacgtgttaacacgtgaccgatatgtggttttccgtttgcagtcggaggaccatcatagaacgtataggtttctccctgctttctctgctccatactttttttgaagatattattatctgcccagaatttttccgtatttttttctctttctacgaaattcatattcgtatcgactttctgatacatcgtgttactcctttctttttttaaaaagaatctctcttgcgagattctccgcctgcggcgggtcgcttttgcgacatgtttccataccgacgcagtgcgaacctcgcggagtgtttttatcatatagaaacgaggttttctatatgataaaaaaaactctcgccctgcaacaggacgagagtaaatcactatcgtttcataccacctcttacacataccaacatacgcgttccttttaacggaggaaaaccggcatcccttactttttatctcaatcgaaaatttcaggcagcaactccggagtgattttcttttgttcttactcgcatcgggcttccaccgtccccgactcgctgttgctttcaacaacaaactactgtctccatcaccgtttttatcttgctttattataaatagggaaagagggaaatgtcaagggggaattcacagtattaaccgtttcatgcaagatggcaaaatcagaacttgttgcagatatagtataaatcccattcgattctataatctgcttcaccaattctctatatcgccaaggctttcccttgtaaaataaattacttcatgataggctatatatacacatgaatatacacgtaaattcacttatcattttatatagataccggtgcagaaaataaaacaggaaaggaaagatagaacatgcagaaaataccacttccaacaggaattgatgattttaaaaagcttcgcagtaataataattattatatagataaaactattttaattgaacaggtcgtagaaacccgaagtgaagttactttattcacacgtccacgtcgttttggaaaatcattaaatatgagtatgcttcaaaatttctttgaaatcggaacagacccttccttatttaataacctgtatatttcaaaaaatacaaacctgtgtgaaaaatatcttggaaaatatcctgtcatttttatcagtttaaaaggaattgatgcagattcctacgaaaaagcccgtgcacagctgataagaacgttaaaccgtgaagcaagaaaattccaatttcttttagaaagtgacaagttaacaaccattgataaaaaattgtttttggaacttttagaccgaaacatggaagaagatgcgattaccagcagccttcaggaattaacggaattattggaaattcattatagccagaaagttatagtactgattgatgaatatgatgtgcccttagcaaaggcgcatgaaaatggttactatgacaaaatggttcttctgattcggaatctatttggaaatgctctaaagacaaacaccagtcttgcatttgctgtcttaactggatgccttagaattgcaaaagaaagtatttttaccggtctcaataactttaaagtctattccattaccaatgttcagtttgatgagacttttggctttactgacgcagaagtaaaagaaatgcttcattactatgaactcgacgataaatacgaagaagtacgagaatggtacgatggatatcactttggaaaagcagatatctactgtccatgggatgtggtaaattactgcaatgaccatttgaataatccagatgcagaaccggaaaattactggatgaatacgagcggaaacagtattatcaatcactttatcgacagcataaatgaaccggatatgcttacgaaaacagaattagaaagacttgtaaatggaaaactggtgcgtaaacgagtcgataaaatgattacttataatgaattgtattccacaatggataatctttggagcaccctttttatgaccggatatctcacacagcaggggaaagaaagtgacggacgctactgtctggcaatcccaaacagagaaatccgaaatattattactgaacggattcttacactgtttcggaatgaggtgaaaaacgatggcaaaatggcggaaaaattctgtcaggcattgataaatcaacagccggaaaaagtcgaagaactgttaaacgcttatttacaaaaaacaatcagtatccgagatactttcgtacaaaaagcatttaaagaaaacttctatcatggtatcttacttggaattttaagctataaaaacaattgggatgtctcatccaatcgagaatctggaaatggattcagtgacattttgattgaaaccgatgatccagaagtcggaattgtaatagaagtcaaatataccgatgacaatggctcaccggaaagtgactgcaaaaatgccttaaaacagattgaaacgaaaaattacgcacaggcgctggaacaggatggaattcggaaaattttgaaatatggaattgcgtttcagatgaagaaatgctgcgttaaaactcaaggttgaatcatatctgaaaaccagtcaaaccattaggtacggggaatttaacatattctccgtacctgatgcattatactaaagcacaatatgaattccatttggttctataatctgctaactgatttgcaatacgctcctgcttttttgatggttctcctgcataaaaagcgattttattgaaagtaaaatgattgatttcaggaattgagatagaatcttttaagaaaaactctacatcttttcccaatgcctgtgctattttttccatatctgtaccactttcatcctgcactccggttaacaagcgagataatttattcttatcaatccctgtcagcatactaagacagttctgcttaattttcatctccgacagatatttgtttaaattatttataaattttgtcatgttattctatcctctttagtgttgtgacggtttacactttataatatatcatacacctttcttcttatttatcgatatttttcttatttatcgatatttttcctattttttgagattttaaattgtttttttgctttaatttgatttttattttttattaatctattatattttcttattttttgagtgtttcaacgaatggaaataaaatagaagcttccaattctacttctatgtaaattgaagctattaaatttaatagcgacttataaatttgatagtaactttaaaaataatcacctccaggctataatgaagcaaaatgatagcttaaaggtgattttatatggcgagatataagaaaaaattagagaacgtcctcccccaaccgctaagccggttgagggagaacaagcgaatattccgtatcgtggttacgatttttcgaatccgtacatccattttcctcgtaagaacagatacagaaagatcacggaactgatactccaggttaatgggtatgcccagaaaatcactcgtatatctgggagaatacgaactgccacagtaatgtagcttacgcgaaacagacaccagtcacataacataacgatcattggaacggaggcattgcctgagccacgaagtactgctgcgatacaatgagaaaatgccagcaaacaataaaataatgcaataattctagcctgcatgactccataatgcacaacatcaggatctctgttaaaggctgtgatcagtatcggtgctgccgcatatatgataatacctatcaattctgcaatcgcaatcgaacaaagtacaccaaattttgctccctttttcgcccggtcatactgttttgcacccagattttgactgacaaaggttgtcagagccatcgtaaaacaggttaccggcaaaaaggcgaatccctctatcttagaatatgagccacatcctgccattgccatttttccaaatgcatttatatttgactgtacaaaaacatttgcgatcgcaatcactgaattctgaaaaccggatggtacaccattctggatgatctgctttagcataaaactgtcaaagcgaatctctcgcaattccagacggtattcctcttccactcgcagcagatgaaccatacagagcagtgcactgacaaactgtgaaattgcagtcgcaagtgctgctgatccgacacccataccaagacctgcgataaagaaaatatccagaacgacattgacacaggaagaaataatcagatatatcagtggatgacgtccatcaccgactgactgcagaactccaacaaagatattgtacatgacaacacctatagagcctgcaaaatatgtacggaaatacacaatagattctgggagcacatctgcaggagttcccatcaataccaggatctttggtgccagaaacatccccagaacggtcagcaaagcaccggacacaagcccgaatgcaaccgttgtgtggattgccttttgcagaaagtcactttttttagctccataatatcgtgcaataacaacacctgcacccatggcaatgccgttaataaaacctaccattagaaaaatcagatttccggatgaactgaccgccgccaacgcattacttccaagaaaatttcctacaatcagggaatcagcagtattgtacaattgctgaaacagatttcccagaaacaatggaattgcaaaaaaaatgatcttttgggagatacttccctctgtcattctcagactctttttcatagccaaaattaccctttcccttcctgcgttctttgcgtgaatagagataaaggactgctctttatggcagttatctctctataattagtgaactactcagctacaaataaccgagcttcttgcttaaaaattaattggctttctgtcggttaataaatgatagaaaaaaccagtctaatcatatcacttaccctttatgttttcaaataaaatccttaatttttctcatctaatctcattttttttcattttcttaatgaatccttagttgagatatcgccataaatggactatactattaaaatgtgagtgtcaaagttaattttgccacttaccaatgtacatttttttataaggggtttttattttatgaatcatttaaaacatcgggtaatctctgctgtctgttcgattacccttttatccggcactttttcacttccggtttttgccgccgacgcaaactcttccgaaaacacggaagcaatttctcagacttctgaaactgctgcaccgactgatactacaactgcccaatcttctgatccagcttctacagatactacatctggcacaccgccgactgacccaaatgctccgcctgaaagttacaactgggaagttcaatccgattcctgggcttcctggccaaaaggtccgcaagtcgctgccgaaactgccattttaatggacgtcgattcaggcgaaattttatatgcaaagggaattgatgaaaagcgctatcctgcaagtaccacaaagattatgactgcatggcttgcgattgaaaacagcaatttatccgaccaaatcacgttttccacagatgccgtctacagtattgaacccggaagcacccacattggaatcaaaccgggtgaaattcttacaatggagcaaagcctttatgcggttctgcttgcttccgcaaatgaagtctccaatggcgtagccgaatatgtcggcggtggaagtatctctgcttttgtcgataaaatgaatgaacgtgctgcgtcccttggctgtaacaacacacattttatgaatccaagcggtctgcacgatgacaatcattatacaaccgcacgtgacctggctacaattgcccgttccgctttccaaaacaaaattttccgaaaaatcattggaacagaatattatatagaaccaaaaacaaatatcactgatgaagaacgctggcttaataatcataacaaaatgctgctctccggtgaaaaacattatgatggctgtcttggcggaaaaaccggctacactacaaccgccggaaatactttagtcacctttgccgaacgtgacaacatgcgtctggtctgtgttgtccttgccgacaccctgcgttttcagtacagtgatacggcttcgctgtttgattatggatttgggaattttcataaagaagtgataacagaaaatcagccggaaactactgttcaattactgcctgcggatgcgttttcgctgaaaatgacaactcccgaatttctctcctgcgtggaaaacggcaactgcgtaaccctgccaaatgatgtgtctttagattcggttacttatgaaacacgcgtggaaggcgattccgtatttactgactgtctctttaacaatcagatattaatgacgaaacaggtaaagattttaccatcaaaatcaattcaaaaatcatttaaagcgatgaatcaaaaaaagacatcaaaatcaaaaaaggcgaaaaaaagacatcactgatgtcttttttcacgccttttttcccgaagcagatttcgtttttcccgaatctcaactgcttcttcttcattaattttctttactgtttttactacataataattgccttcatcggttttcttcaaccggattttcccttttaaataaccgtgttccggacaatatgccaggcagacatgggatttggtattcatagaaaaccagcgtattttcttctttgctgtattattacaaacaatgcattttgtacttacgacttccctgtctttcattgcgtcttcttttgttggaaattctcttgaaatatattttgaataattctcaaacatgacatgaatttcttcttttttggatttcggattctgataagtatcaatcgagtaatttttctcaaccacctcaatcggcaattttgcaaacacctctgccgtataccaggcatcatgaagtgcacggtgaaaactctctgtcttttctattttaagaaaatcaattgcatattccagggaacggcagttttttttaccctcacaggcaatcccaaagattttctgaaggtcataataacgaaccggtccttctaagaaatgcagcatggtatagtatttcaaatttcgctgaagttcaatcaaatcagttggtccccaggtacaaaatacaacgtcctctccacaccatctcaaaaaacgccttactgattttgaaaaagaaagcccgctctctaaggtatttttatcaatgtttaaaatttcttttgttcgataatgaagtctgtgatagacagccggttttacaatctgctggaatttatcaattacttctcgattttcatctaattttaccgctccaaattcaataatttcaaacggcaatcttttattttcacggtcttttccataaggacactggttccactctaagtcaaatacaatataattcatttctttcttctcactaactaactatttactctgctgctgtaatattaccatgatgacctcttattcgcaactgaaaatcatagtacagaaaaaaaagcaatacatacttttacaaatatgtattgcttcttctctttgttttttattcttccgctccaatctgcggcattggctctgccagaattttcataaattcttcacctgtaattgtttcattatcgtaaagatattttgcaagctgatgcagttttccgatattatcctcgagaatcttataagcttttgcatgctgggtttttaccagttccacaacttttttatcaatctcagtctgagtttcaaatgagcatgcaagggaagtatctccacctaagtactggttctgaacactttccattgccaccatatcaaaatcatcactcataccgtaacgggtaatcatacctcgggcaagctttgtcgcctgctcgatatcattggacgcacctgttgtaatggaatggaaaatcaattcttccgcagctcgtcccccggtaaaggttgcaatcttattttcgagttcttcttttgacatcagataatgctcgccatcttccacctgcattgtataaccaagtgcaccggaggttctcggaataattgtaatcttatgaaccggtgcagaatttgtctgcatcgctgctacaagcgcatgtccgatttcatgataggaaacaatcaatttttctttttctgaaagtacacggctcttcttctgataaccggcaataacaacctcgatactttcttccatatcagcctgtgttgcaaattttcttctgtcacgcaccgcacgaagcgctgcctcatttacgatgttggcaagttctgcaccggacgcaccggacgctgcttttgcaatttctctaaagtccacattatctgaaactttaatctttttcgcatgtacttttaaaatttcttcacgtccctgcagatccggaagttcaaccggaattcgtctgtcaaaacgacccggacgaagcagtgcaggatcaagtgaatccgggcggttggttgctgccagaataacaacaccttttgaaccgtcgaaaccatccatttctgtcaaaagctggttcaaggtctgctcacgctcatcatttccaccgatatttccatctcgttttttaccgatggtatcaatctcatcgataaatacaatacatggggctttttcatttgcctgtttaaataaatctcttacctttgctgcacccataccaacgaacatttcaacaaactctgaacccgagatagagaagaaaggtacatttgcttcaccggctactgcctttgcaagcagggttttaccggttccgggaggacctacaagaagagcaccttttggcatagaagctccgatttctctgtatttttccggattatgcaggtaatctacaatctctgtcaaaagttcttttgcctcatcttcacctgcgacatcagaaaatttaattcctgtggaagatttcacgtaaatctttgcattactctttccaaatgacattgctccaccggcgccaccaccgataccactcatcattttcttactgagccagtttccgataaatacaaaaatcagaatcggaacgatataagacaataataagcttacaatcggagaagttttctgcggaatttcttctgagaattttactcctgcatcttttaagcgttctacttcctgtgagtctttgattcgaccggtcttataaacctgcgtctcatttcctttttttacagaatagtagatgacatcatcttccagattgacttcttctaccgttccactgtcgagagtatccaagaactcatcataagtggcttccttgatacttctctctgcaaggcttggtaccaaaagtgtatttaacagcaccaacacaataattacgattgcataataaaatatcaagggtttttttggctttttatcttttatctccatagccatatcccctttcttttttctttgtaaactactcggcaaccaagttaccaaagcatctaaattaagtagttccttaacacttgctatactaactattactattatgcgccaatttttacctatttacaattaagaaaccctgttaattctctaaaaaaaaaatgaaatttccagttacttatcttaattaattatcttctccggttaatcttaagattccctggatttcttccaaatccatatccaaaaatgcagataactcttcggcactgtatttatcatcatcatcatccatgatttctttgattttatgctccagatttcttactttttctactaaaatatcatcgctctgtttctgatctgtctgttcctctaacagcaataaaattgcatttctgatttcaccggataaaaatgcagaaatatcttctgcttcctcaagactttccagtgcgccaatcaagccgatatttccctcagaaaccatatctccaagaaaaacctctccgtcatgcagctcttttgcaattttaagcacttctttcatatataattctgttaatcttgattttgcctgtgcctctcctgcttttgctaattcaaaaagacgttctctttcgccttcctcttccggaagaatcacatttaatgtttcaagataatcctctaaatattccttctcttcctgtgtcagctcggtcgattttttctcttcttctgcctcctctgcttcataagaaaacatagaacttttctttggcatttctggctctgaaactttttctgctttctttttctcttcatccgtatggattccctgaatggtcagataatcatatactttctgaagctgtgtctcatttaagccatctcccgcaaaaaaatcctccactacctcacggctgatttttcttccattgttgactgcaagtctctgtatatcctgtaatttctgctgaaattctttaatttccattctaacctaacacactcctttttctcacccaattccacccagtgcaattccaagaatcaacaccagaatgcaaatcggaacatataaatatttgcaaaccggataaaaccatttcgtaaatgctttttctcttcctttattgacctgttcttccacgtatttctttccgcatacccagaagaacataattcctgccagtcctgctccgagcggacagatataaatcgacagcacatccatccagtccgatacaattccctgaatcaaaagggaaatcacaattccaactatacctgtcaaagtacatgccggtactctgccaagttttaatttttcttgaaccgtcgcaatcggtgcttcgtaaagattaattaaagaggtcattcctgccagtaaaactgcaacaaaaaagagaatcgcaatcacatgccctccgggcatagatttcatcagatttggaagataaataaataataatccaggtcctccctgatttaatttcgcaccggtcgttgccattgccggaataatgacaagtgctgcaagcattgccgcaagcgtatcaaaaaacgccacacgtcccgcagatgccggaatattctcttcatccgaaagataagaaccataaatcaaagttccgtttccagctacagaaagggagaaaaatgcctgacccagtgcaaaaatccatgttttcggatttgcaagtgcagatttatctactccaaaaatatatcgatatccatccgatgctccctgctgaaatgatacatagattccaagtcctataaataatgcaaagaaaatcggcatcataattttgttcgctttttcaattcctgttgctacaccgaacatcaaaattcccatgcagagaattaagactaccacctgccagatattatttccaaatgcagatgccattgaaccaaactgtgcaccaaactcatctacactttccggtgcaagcgttgctccggtaagcgtacccacagtgtattttaaaatccatcccataactacagtatagccgattgccattgccattgaaccaagtaccggtatcatgccaagcagttctccgctctttctgcttccttttctttccgtcgccattccaaatgcatcaatcggtccggaacgtgctgcacgcccaaaacacatctctcctataactccggtcgaaccgattagaattacaaaaataatatagggaattaaaaaagctccgcctccgtacagggaaactctggtggaaaacatccagatattccccataccaacagccgagccgatgcaggccaaaataaatccccacctgctgttaaatgattctcgtttcttcataaaatttactcgttttctccttgtatattttgtatttgaattataacaaaattcaggagaaaagtaaattttgtttgtaacttattcagcttggttcttccattttgttccaagttcttttaattcttccgcagtgtaaagcggacaaatccagtatttttcttccagccagtttttcattaatactttattttctttttgagaatagcctgcaaactgacctttgacatcatcgccgatttcatagcggatttccattttatccagattaattaaccaggcctgattttgattttgaagtaaaatctcatcaggattttgtgttttccagactacaacatattccgacttttctgcatcatcttctttcttctctttaattgtaatctgctcttctattccatctgaatttttatttactttataaagaatcccgtctctgccaaatacaaatacataatctccaattttatgactccagaaaacagaagataccagattcttctcttgaagcttttctatcaccggttttattttttttgacttcgtgtcgtccgagtactttacatttttatccttagtctgataaatcagactatcctcttcctctataatttcacacgattcattcgttaaatcctgataacgatagaccacatttccacttaccgccagttcatcatcattataccaggcagaagcatcgatttcagatgcaaattcatgaatcactgcacctactgatttttctttttcccctttttctattccatttacaaaaagcatatattcttttccattttctaaagtcactaaaatctgacctgcttctgtataatctatatttataatactgctcggaaatgtatattcataaataatatctccggtattcacatcaatcaaataaatttcttttgtcataacagtgaataaaatatccgtatagttttccgtattttctttcttaaatgttcctaccgctaaatcttccatataagtagctgagccatttaccgttacttctgaaagtttttttgctgtattataatcaaaaatccgatactttgtatactctccctgcgttcccatatttgtctctgttatgagataatcacccgtatgcattactgtaggaaccccttctttttcctggtctacgatttcttccaataacggcttttcatcttttaaaattactccatcttttacagaatatgcttttatcttattttcacaatttccaccttccttatattctgtttcattcacataacaaattttatcagagattgattgtatatctaaatcaaaaaggtcatcccattctttggtatatttatattcctttttattttcaatattgttctcatcaaatacaatcagactacagttaccattttgattccacatacccggaatctctttcgcttcttcatactcttcataaattcgggcaatctttccatcaaacatccgataactgtaagtataagtatcactgtcataatgccactttttttcttcttcacttacttcttcaattcgttcataacttccatccgccggattcactttccagacctggtctacgctggtaagataaaaacatggattttcagcctctccttcacttgtagtttttttatagccataaagcatcatttcacttgtcagttcaccatctgactgaccattgccttccgctgaaactttttctaattttattacttttaatggttcttttttaggaataaaaaacttaacactataagtgtcatcgtcatattttatccccaactcctccaccgtatatttcttcaccagttttccgctctttgtctcccacagataaacccctgttgcatcctgtgccaccacattttttccactgtttacaaatgcaactttcgtaatatatgaagttgtctcatatttttgtaccggcaaaaagttttctctctgaaataatcccagtttttctgcggttgctttctctgccgaaaaaaccgacatattatcttcagcatcaggaagtgcatccactgctgtctcaattgcttctgtcacttttccatcttcccacatataatccgactgaacagccatacgattgtagttttcttcctgcaagagccgtttttgttcatttaatcggactgccatgattgaactgtagataccaattccgccaactacaactgttactccgcccatgacggcaagacttctgtgaatttttcgtttctgttcccgctgatataaatcatcataacgacagtcaagcagtggtgcggcaattcgcaaatattctgtttttaatttctttaatgatttcctttcagaatctgcggttatattcgcagccagaggctctacttcaattttctcccgaatttcttctccctctgcatttttacgaatttcttccgaccagcagagttcttccggaaatacatcgcctggatttccttcaattaaaagtgccagtatgtttttggttgaattattatgtaacgatttaaaatatgaaatttcttccctgcaccattttgactgtgcaagcatagaagaacaaattacaattaaatattctgaattttctaatgcctcacggatatcctgactcaaatcagcacttgtcggcagttccgtttcatctcgaaatactctccatttttcctttttttcaagctgtttcggaggatgaaatgtctctaaatgcttctgtaatgtaactgcaacttttcggtcaaatggctgatgccggtagctgataaaagctttatatctccggttattctgctctgtcttattatctgtcttattttctgttttctctcctgtctcaagctctttctccatcttctttctctctttctttcaaccattctaatgccagaagtcttttggtatctttgatatttgccatatcataactgtaaaaatctttatccattccacattcattttttaatgcaagttttaattctttctgaccctcataagcacagatacaaggatgcagctttgccacaaacaattgctgtctttcatttccacatttaacggcaaaaacagcatcatctgcacttgcagggagccagccacgggacaacatccatcttacccagcggtcatgttcccagaccgctatcgtcttatattcactttcttttactcctctacttcgatttgccagataattcagctgttccaccgaagcaaatgccttctcgtcccagatttcccatgcaatcggcataatctgatttccattaatatcccgaaactggaaaatacgatacggcatgctaagagccagactataggaactgtcatgattatattgtcttccataatagaccttatcttgctgttctgccttttcactgcccgctttggtctcttccggactcagccccgcaaactgataatgaatacactttgaaagtttttcaaaagttcctccagccatcaaatcccagctataatatgccgaaagatttccaaacggaataaaggaccaggtattaaaccatctgtctccatatatttccttttcaattaccagtctttttgcagtccatgcaatctggtctttccgacacagaactgcaatcggatttggattctccagtgctgtctcatttctctgttcaatattattacgaaccagaatttcacggattcttgttgccagtgaaagattttcttcatctgattcagtcgctaccgcaaaataaccatacggagtttcattcattatgttctttaagatatccgctaactgaaaagaatgaaaatcaatattttctcctaaaacctccggcagttcaatctcttctacatcaaaatcgctttttaccattcccgggtattctgcctttattttacgaacaaattcttcgcctttctcatctaacaccgtaatcttacataaaatcgcattttcacgaaatcccatcatccagaatgcttcacgaaccagccatttcgcaactctcgatgttcccaaaataataaaatgcaggattggtctgtcttcttttaatttttttgcactttcctttaaatctaccgcacgaaccggataaaacaaagggtgatgagatagcagctgttgtgctgctgttttatcatcatcaattataaaaacaggaatcgtatactccggaagaccacttaatgctgtgtcaatcagagcacgggcgatttctgaatcatttcggataaaaatttctatattcagttctttggtctctggtttttcatcttttattaactgtaataattatgtgaaattttatatctaattttcgattatccgcataaacactatactttcaagtattttgaagtatagaaaaccatttattttaccacgaatttaccacgattgaacgagccttgatatgacactaaaaataacatgggagatagtacaaaatatctgactatctcccgtctttcttaattttattgtaacacttaatgagtatcgtctttttctaactgttcttgcacaaatttaatactattctggataaattctttatctttttctgttgcaacttcttctaattgtttaaacaaagcaatgctttcatttcgtttacctaatacattaaatgcagttgcaatattaagataccatgtcatttcatctttcatatctttaggcttcatatccattgcaagaagtttttctaaaaagagttctccgtttttggtttcttgatattcttttacaatatcattgttcatttttctaaactgacgtcctctccgcattaaaacaaagaatacaataaagaaataaacaatagtaataacggcaataccgccaacgataatgcctaaaaaaccaattgttgattttacatagggaattactatgttcacataaataaatagtagtaccgcccaaaatagaaaggctaatcggataagccatttatctcttttttcatatattgctcttttattttttagattttcgggttcgtaaatcattttttcactcctttattactacatcactcagaatttgttgcattattttgttttttccattccttataatctttttttgtttcttgttgtcttttaacatcttccattttttccaaaatcacttctacctctggttgactgtgttgttcgggtaaagaatagaaaataaggttattatcgtttgtatatactgaaatattaaaaaccaaatcactttctacaatttcttgcatgatataggaaatttcttctgcatattctttatcagtttttccctcattaagatatatacttgtttctatttcatattccctttttttcagatattcttctacactttccttaccattccattctgttgtggttgtatgcccttgaacttcaatttgataacctcttataaaaggcttatcttgaaataaaggagttgcaagttcttttatttcatcagaatagtaataaacatggtaactatcctcgaaaagtccagtatttcgtgtatatacagtagcagtttgagaagaattttctttactggaaacatttgccctaatccagtttaatcctattttttcttctttgtacttcttcacttctgtaatgataaattcttcattgtatttgtcctttaatttggataagatatatttttgtgcttcttcactagagttaaaatcatgcgaataaccgctacaaccatttaatagtcctagacagagtacgcttgctataacgcctaataaaaattttttatatcgcataattgccacctcaatgtgattttataatttaatactgttctacaaactggaattttttgacactgttaataggcatgtgcttcaatatttttctaatttgattattttatacatctcccccatatattcccctattttgataatttagaattgtatgatacatttcttcatcatcatattcacatgctttagcttcatcagaagaaatctcgattctttttttctttatcatatgtgttccagcatcatattctaaataatatttacttttacacttaatcagtcttattccttcattctctttaactacttccatatttccctcattcaagtcaaagttactttagtttgcacattctttatttatgttcgattgaaatgcttattttacaatgtccgttttttctatcaaaccatttgtgatatttataaaatatcttttaccataaaaatctgttgctgtcagtattctattgttaagaaatatattttcaaatggtaaattacgtctgttaggctttcgattttctactttccatatgattttacaatctaaagaaattgcatatatattagatatttcatcaacaccaaatggtattgataataatataataacttgattatcaactaccttgatgtctcttatgtcgtaattaaacttaattgtatttttatcaatgcttaattcatttttgttgattttaataacggtattcattttctacctctaatcttaagttaacatagatttacaacttcaaactggaatttacatttataaatacttttcatagttactcaataattcaagataaaatggtcgcaagcaggtttggtcaacatcattttcaaattccaagacttgttccgagccaattctatcgcccttatggagataacctttaatagcaatgtgtcctctgttattacctacaaaggacatatacatatgttgtccataagattcctcaagtcttgcattgccttgcaaagtttcgtagatttgacataaatcttttccaagtttagccaagtcctttatatctatatccatagttgtactcgctgtaaagccattacttttaacatcaattttaagtattgtgtttgttgataaatttatatctgcttcaaagatttcaggctcaatacaaacaaaaaaattttctgtttcaataatatgtttcattatgtgtcacaccccaattccgatttgtcgctttcttcatgcccatattataacagttccatatatccaccacaataaaaatcaacataccctttaaatattttctgcattgaacatacacactttttctttcttcctcttgattacccaccacagaaaagaaaaagccctgtcaagagccttgccaccattggtggtgctttgcactctttactgggctttttgtttgctgtatcttccatgcaagaggaaattaaagacctctgttccatttcgcctttagataatcttcataatctccctcattaaagtctacttgtggagaagtattaggaatattttttctgttatctatatctgcaagttgacggaatatccagtcatcataagggttgtgatatttgtattctttcggctgttctctgtatcggtctaaccctcgcatttccttatgcactttcatcatgcgttctattttttgtcgttgtatcaactgtttgatttccataagttcttcaatttctacaacctcattagaaagataattactgatgtatctaatcaatatggtttccatgtaaaatctgtattcgttttcattttcaaaaaattcattttcagacagataatctaaagaaacattgaagtcttgttcccgtttgataatatccatgatatatggctcggtgtggtcgacatacttccattctcccgataataattcattgggcgttacacccagcacgtccattatcttttccagcgtatcaaaggtaggataattcacaccacgttcaatcttggaaaggctctgcatattgataccgattttgtccgcaagttcctgttgtttcattcctctgtattttcttatggtttgtatgttctctcctaagaaactgattttcttttcataatgctccataacttggtataaccgctcctttcgttgctttttttgacatttataagcatatcatacttaatctatatccaaaagtcaacaaaaacttcttgacaagtaattctaatggcgttattatcgtgttagatagagtgattaagcacgctagggtcaatcacacgcttgagtaagcatatagaatagatattttcactttgatagcatgaataggcatggactatcagactgaaaatcgggtttctgactgggctgttccgtttagccacgagccttacaaggctcgtgagcgttaagaacggggcagacacaggaagaaagggaacgcctttaggcgttcgtaaagggcgtatatgtaacaccgccctgcgcatacatgtcatagtacctagaaactgtgataaataaaggaaaaaacacgatttttaccccgcaaaaaacggggcatacgaaaggagtaatgcactataactacacacaaaaatttatccgttaagattgattacatcagtattgtatttgatactgcaaccgctgaagatatcatcatgcacattttaggtttaccgactgatattttcaatgtctatccggcaagcattaaatacaaaacctatcaagcacgctggcagattggagatatttatgtatcgggggacgcaaggaaaacagaggacaacccacaagggttaggctgttatcttgttatgaccggcagaggttgtgatgatattttccgtattctcgacagtaggaattatacctttggggatatgttcaaacattgtgagcgaagatacggacgggataacttccacttcacaaggcttgatattgccattgacgataaaaacgaaaagccattttttaccatagagcagataaagaagaaatgcgaaaaagaggaatttatctcgaatagtgagggctaccactttgatgaaagcaagtttgatgatttcgacaccgcaaagactgtttatatcggtgctggtaaatcgggattgtcctaccgcttttatgataaggataaggaagtctgttcaaaacataataagacgcttgaggaagtcggcagttggaaacggacagaaatgcaactgcgtgatgataaggctcatgcttttgccatgacattcaagggcagaccgctggaacttggggaactggctttcggactgctggcaaacaacctacgctttgtcgtaccaaacagaaacgaaagtaataagagcaggtggaaaacttgtcggttttgggaacgctttttaggggctgtggaagtcttgaaactgcaagtaccaaaacagcaaaattcccttgaagaaacacagcaatggctcacagagggtggcgtgatttccgctgtcaaaagtttttacttcttggaagaacatgacgcattaggtggactggaaaaagtgggaactatgcttgataaggcaagatacagcaattccctttccagtaaattaaccgcccatttacagaggataaaccgcaccgaccttatcccctatatccagtatgacacgaaacatgggaaagggggtatctgatgaacaacaacgatattcccgtatgggaaaaatacacccttaccattgaagaagcgtcaaggtatttccgtatcggagaaaacaagttaagacgcttggcagaggaaaacaaggacgctggctggctcattatgaatggcaaccgcatacagattaaacgccgacagtttgaacaggttattgacaaattggacgctatttagtgcaaatgagccttgtatgtgttatgatgaacacaagtcatatcaaggctctttccaacaaggaaaggagcagacaccatgaaagaaaaaagacgggataacaaaggtcgtatcctgcatactggagagagccaacgaacagacggaaaatacttatataaatatgtagacgcatttggaaacacaaaatatgtgtatgcttggagattgacacccacagacccgacaccaaagggaaaacgggaaaaaccctcacttcgagaactggaacagcagataagacgggatattgaggacggtatcgacagcacaggcaagaaaatgacgctctgccaactctatgccaaacagaacgcacagagggcaaatgtgaagaaaagcacaatgaaacaacgggaacaactcatgcggttattaaaagaggataagttaggtgctaggagcattgatacaatcaagccctctgacgctaaagaatgggcgttacgcatgaaagacaaaggcttttcctacaataccattaacaaccataaacgctcgttaaaagcgtcattctatatcgctatacaagacgattgcgtaaggaagaacccttttgatttcaagttaaatgaagtcctagaaaatgataccaaagagaaagtcgcattgacagaggaacaggaacaagccttattgtcatttattaagacggacaatgtgtatcacaagcattatgatgatgtgctgatactgttaaaaacaggacttcgtatctcggaactgtgcggtctgacagtagccgatattgatttcaagaatgaagttgtgattatcgaccaccagttactaaagagcaaggaacaaggctattatattgaaacgcctaagacgaaaagcggaataaggcaagtaccattaagcagagaaacgatacaggcatttcaacgggttatgaagaaacgcccaaaggcagaaccatttgtgatagacggacagggcaatttcctatttgtcaatcataagggcaagccaaaagttgcgattgattacaacgccttatttgtccgtatggtaaagaaatacaacaagcaccacaaagacaatcccttgccacatatcacaccgcatacgctacgccatacgttctgcacaaggctggcaagcaagaacatgaacccaaaagatttacagtatatcatggggcattcaaacattagtatcacaatgaattggtacgctcatgcgtccatagataccgcaaaatcagaggttcagcgtctaatcgcataaaagtatttaccacgattttaacaacgattgatagagaaaatataagaagatagacctagatatgcgaggtttaccacaaaagcaaaatgcccgtagagcctataaaataaggctttgcggacatttaagaagatataaaaagatagtcaaaaagacatatataatttcaaataaatcttctatatttttttcaaaatcatcatccaaaaacaaaaaacgttttgccgttttttcatgaattttcatttgcattaccgtcagatcaaactctgcaagccatctctcccagctttccgggatcgtcttttcgaatattttggcatatttattctttgtatttgaatagcatcgtcccactgtggcagtttctgcccgcataacctggggtataatccgactctcattatttactttccactcttcctgcgccagataaaatccacagttattactgattttcagataataatctgcagtttcatttgttgaagattgatattttcctgcacgaatatatttatataatacaaatgctgcctctccacgataacttttctctactgcaggtgttaaatatagaattttctcacagcctttgcagcatctcatcacatcttctccatcagatgccggattttgataaatgattcgtattttctctaacatagcttcagcatctgcattatttttccaaagttttgccggttcataagaaaacttaactgcctcttttaaaaatgcattacctgcttttttatcttttagctgataggctcgccttgcaagcagataattggcttttcctttctcgtatggattgtttaatgcaatccccagacattcttttagttcttccagtgagccttcttctctatgaagcatttcctgagctatttttatcgcatccgattcttcctcttcttccacaagcttcggcagaaataaactatgaagttttaaatcctgttccgaaaatttcgtattttccattccaaaactgcataacgtagatgcaataatcgaaaatactgcaagaatctgtgcatattcctgtttatcataaagctgaaataatctttccttgataaacaattcatctttttcttcctcaattttatcaatcagacgataaactgctttcgcaactttattttcctgcgtctctgtacatgcaggtactaatcgtttccagttttctgcgaattcctgaagcattggattttcttcaaaattataatcctcatgcgcctcattttttaactgaatcagataatcactcgcatccagaaaacgtttttttgcatcaatagtcgcacggcagactaaagaaacatattttccctgaactttcccacttcttacaaacattttttgatataaaccatccggaaaaatttcttttataaatgttttctggtctgactcattttttgtaaatttgacataaatatcttcatataattgtttccaagtaatttctatcttccacacagcgaatccccctgagttgttttatgatttcattatacctcattcgatgcataatatcttgcatttatcttataattctactcttttttctttcgatattaagatataataaaagcagattaaaattcaaaagggggaaattcaccatgacaaaacactacatagaatccgatattcgaaataattaccgtgccttaaccaaatgtttaattgaaaaacacttaagcatcaccacaatggaaagtgcaacttccggtcagattgcctctttaattactgatacggaaggggcttctgccattttaaaaggggcttttatcacctactcaaacgaagccaaaattatgcagggtgttccggctgaaattattgacacttactctgtctattcaaaagaaaccgccgaagcaatggcatgtgcctgtgcaaaagcttatcttgccgatattggaatcggtgtaaccggcacaatgggaaatattgacccagccaatctgaatgattctgttccgggtcaggtctattttgcaattaaaattcataataccgtttcatcttactatgttgaattagagccacagccgaccagactcgcctataaacttgctgtggcaaaagaagtatatgataaattaatcgaaatactggaaagttaaagtcaaacaggcagtgtccatccctttagacactgcctgtttgcctcatttcttcaaaatttgttctatagtattcaactcaagtatcttcatgtgtgccaaacaatttctcgcatttctatagtcttcaaagtggcttagaattccagataccgtctttttcagaaaatctttctttcccagttgttgtttccaattgttttccatgtaattgccggtaagcacgaggtccgctgccataatatttttcaaaggtagctgcaaagtgttgtctgctgttataaccggtatgaaatgcaatatcagtaatcgttaaagaactgttgattagcaaaaatgctgcctgctccagtcgttttcgattaatgtagtctgtaattgtacagtgcatttgtctggaaaatagagattgcagataagatttattgattcctgcatatcgagcaatctcaggaattcgaagttcttctgttaagtttttacgaatataatcacaggctttttttaaataaagagctccggttgtggattggccttgataaagacatcttgagagttctaacaacatccgaaaaaaaagcagacaaatcaaataatcggaatcaaatttctgaagatgtttttgacgctgaagacgtaaatcatccaaagaaagtgtcaactctaattgagaaatcaaatcttttaaagagtatcccagattataaatatctgttccagttaaatgagagcaggaatctttgcaaagtttcaggaataaatcactctcctttataagttcagataaattgatttttgttctttcttcctgacaggaaaattccaaattcagcatggaacaaaattggtcttcttcaataaataatcggtgtgggagatttgcatcaataaaaatgaattgatgagcttctaaaaggtgcttctctttttcaataaatacttcacagcaacctttggtcacatacatgatttcaaaacttggatgagaatgaaggttcatcttataatcactaagagaaagtgcataaaaagcagtgagtgaaatgtatggttttgatggataatacaaattcatgataaaaattctccttaaataaaatacggtaatatcttgcattttttaatgaaatcaacaatagtttacacctaaaaaaaatgctttgtctataatgaattcatagataagaacgatagaaacaggaggttttatttatgagttttaaaatagcatttatcggagcaggaagtcttgtatttgcaagaacactttttacagatattatgtctgtaccggagcttagaaaagcagaaatttcttttacagatatcaacccgtataatctggaaaaaacaagagcactttgccagagagaccttgatgcaaaccaaattccggttacgattcaggcaacaacagacagaagagaggcatttaaagatgcgcgttatatcataaactgtgttcgtatcggaggactggaaggatttgaaacagatatcgaaattccgttaaaatatggagtggaccagtgtgttggtgatacgttatgtacaggtggaattatgtacggacaacgtgtaattgctgcaatgctggatttttgtaaagatattcgtgaagttgcagaacctggtgcaattatgttgaactattccaatccaaatgcaatggcaacctgggcatgtaataaatatggaaaagtaagaaccatcggattatgccatggagaaattcacggagagatgcagattgcagaagtactgggaattccgagagaagaactggatattacctgtgccggaatcaatcatcagacctggtatatttctgtgaaacatcatggagaagaattgttagaccagattcttcctggatttgaagcacatgaaaaattcagagaagaagaaaaagtaagaattgatatcttaaaacgttttggatattattcaaccgaatcaaatggtcatctttctgaatatgttgcatggtatcgaaaacgtccggatgaaatcaaggactggattaatctggataattggattaatggagagactggcggatatctgcgtgttacaagagaggaaagaaactggtttgaaaccgattatccgaagattttagcagaagaaccaaagaaattagatggttctgaaagaggaaaagaacattgttcttatatcattgaggcattggaaaccggcaagaaatacagaggtcattttaacattatgaatgaaggctgtattacaaaccttccgtctgagagtgttgtagaagttccttgctatgtagatgggaatggaatcagtattccgaaagtaggcgaccttccactgggatgcgctgctgtttgctcacagtctatctgggtacaaaaacttgcggtagaagcagcagtacacggagatgtgaatctgttaaaacaggcagcattaatggacccgttaaccggagcagtttgcaatcctccagaagtatggcagatgattgatgaaatgttagttgcacaggaacagtggctgccacagtacaaagaaggaattgcacaggcgaaagaaaatcttgcaaaaggaaatctgattcctacaaaagaaggatataaaggtgcagttcgcttaaaagaaaaaacggtagaagaagtagcagcagaacatgataaaagaaaaatcactgcataagataagactatagttagagtcagacagtgtcaaaaagcgacactgtctgattttttataatataagagtaaagcgttcaatcaacaggtataataaaggtgctcatttaataaaaaacaaggactgaatttccaatattcacgaaattcagtcctcactttttacttactcaatttatacagttttgcatcatgggaatccactcccacaatcaactttccttctatttcacctaattctttttgcgcccataaatcacgcagtttataacttccagttaaatcaagcgcccgaaaatcaattgcgaaagtctcactccagtttgtcgtattaaacaccgcaagaaaaacatttccttcttcatcttctgcctgccatacaatcatgtctccctgacggattgcctgatgtgcattgcggcttgtctttaatagacttaacacttcttcatttgttaaaagtgcttttgtccattcatccatatccgtaagttcacagccaatcataagtggcgaacggaaaatattccacagagtgagcatagttcgttgttctgcctttgaaagtcttgtccatctgtcacttaatccatgttcacaacctctgatagaaatatgtccgaccggaagcatatcacaatccgggaaacagccttccgatacataaggtgcccagttattacatctgtcaaacatttccataatatcttcccaggaatcccagaagtcattggtgattctccaaagatttgcatattttcttaaatgctcggctttctctaccattgccggtcccggtgaaagacttaagacaatcgaccgtccacatttttcaatcgctctgtggagcatttcaatttcatccccgccatactgcaatgttccttcatcgttgatgcgaccatattttacacagatatcatccactttaatataatccactccccaggacgcatacaattccaaaatagaatcatagtattcctgtgcgccgggttgtgttgaatctacaccatacatatccgaattccaacagcaaattgaagctggatgtgcaacctgacgtgccgtataggaagttcctttaatcgtcacattttttgcaactgcctggcgcggaattcctctcataatatgaattccaaacttcaatcctttcccatgaatataatcggcaatctctcgaaatccctttcctcctgctgccgatggaaaacgattttcagccggaatcagtcttccatattcatccatacataaatccgcaaatttatgataatgactggaatccgctgtcggttcataccactgaatatcgcagatgatatactcccagccatatttcttcaaatgctctgccatataatccgcattttgctttaattctttttctgttaccgatgctccataacaatcccagctattccagcccatcggaggggtctttgcaaaatcatttttattcatacttttctccttctattttaagtcaatctcaaacaaacgcgcacatttttcctgtgggagttctacgcacaactcattctcatcataacagaatttacaatctacggtatccggatagatgaccgatactttttcaatttcttttccaaagtccagtggaatcttgacgtttgcagtttttggtgcaagcactgcaagatatactctatcctccgttttaattccgtaaaccagctgtttactttctaaatcagcaaatccaagcggaaaaatcggaacgccatcctttattccatcacgaatctgtttataaagtgcaattccttctgccataagtttaagattttcctcactcattttccataccattccacttatgtatggacgaagcaggagcccatttaccatgttataaatgacatgctctctatcatcttcataaggataaacccacatacccgcctgttccggtgttactgcacttgcaacatttactccaatataagaattgtaaatgtaatccgtctggtcactggtagactgaaggcttaaaagtttcatcattccataatccattctctgtccgccagaaccgcagttttcaattacaaggtcaggatgtgctttaaaaatttctttataccattgatataaacataaataatgctcatggattgcatcggaacagctgtcagaatttaactcacttccatatcccatcgtaacattataatccactttgaaatatccaactccataatcctcaatcagacggtctacaacttcacggcaatattttcgaacttccggatttctaaaatcaagtaaataccgtttattatcgatatgacgttttccatgacggcagatgaaccagttatctggaagtttctttgcaagttcacactctactcccatcacttcgatttcaagccagagtcccataaccagtcctttggattttgcatagtcgcagacagatttcattccgtttgggaaacgttccggtgactctttccattcgccaactctgtcccaccagtaccctttatcataccagccagcatccatacagtaatactcacagcccatctcagcagctttatcaatgatttctttttctgtactttcaatcgggtctcccatcagacagttcatataatcattaaatacaatatttaatttcttatcatcgtcattttctcttcggattgctctacgatactttgtcaattctgccattacttcattcaaagaaccatctgcaacaccaaatccaaccggtaccgtctcaaatgtgtctcctggttttaaattcttccaccagccattttccatctctgtcggaccgctaagcgcaagatacagattttttcccatagaagaaccatactctacaagccactgaccggaatgttcaatctggaagaaatacgtttcttttgcttctgtgtcttcacaaattcccatcggaagatattcacaacttgaccaggagcctcttcctccatagcagtatcggtttaacccaaatcccggagtgttaaatccatctaccatcattccatttaaattcaactgttttgcactgtcttttttccactgtgcttcacagcaccagctattatatggagtgtaaatctgtgttttatcataatatggaagtttcccatttgcacaaagaccatgataaacaaaagaagacacatactctaagccaactgcttctgtaccattattttttacttctgtccaaacctgtgctgctgaaatcccatcaaagaactgcatataataactaagttccacaccataatctgatttcgtatggatgattaactgctgacccttctctgctttttccaacgtatgatttacataatgaaactcttccgatgcactacttaaactatgtttatagccatgcatattcctgcttccttttccggtaagctgaatctctgtaatcgaataagatgcctgttcatctcttggttcacgatttctgtctggttttccagcggttgtaaattgttttaattcaacgattccattttcacgaatttcaaagataacttttaatccgttctcctcaatgcgaatttcttttgtctccataatcgtgttcctttctttttcctttcttttcttttttattttattaatcataataccaggcaccgtcttctgttttccttgcctgtttcatatatttttgtaagattttttccactaaaaatgaagaaacccaagcatatactccaggaacaattgccattaaaagcggaaacaaatagcaaatcattcctgctgctcccaaaagcagaatcagtaatattgtaattggaaaatatttcacggacatatgtaatgcatactgaaactgcccaacaatgctcatacgaaatcttgagagtacggaaaaaatatacagtactgtaactgcaaacggagaggcaagtaccattcccgatgcaacaaaaagatatggtgttctctcaaacattccactttttgtaactacacttacttgaactaccccaaccgactaacgtcggatggggattcctacgggctttcgcccgatacccactcgttcagctcatgggtgttccaacagagaacaaacccgttttcaggaatgtttttgtatgttggcgtaagtcagatattcccgtccatccagctccctgcccactcattcaactgactagtacaaaatgactggtaagaatatccgaatatttcttctatttctatatttttgtatttcgctttttctttcttctatcttcttttatacatactcatatcgattattttgcgtccattttttcatttccgatgcaatgctttttaaagttcctttttttctttcttctaagacttcataaggcagttcccggtaaaaactatggggcgaaactccacgaaatgcttttgttaaatgtttccatgctggaatgatactcacaatatctgttccattttttagtttttcttttgccttttctggtaataacataagtaaccgctcatccggtaacagtttttcccgaatttccattccttttaatccaatcgtatacgatgctgcttcatgaatggaaagtccaaatggtcttaaatacaaaaacttccccatttggctggtataagccggattcattttatagattccaaaactttgtttataggcttgattttccaaacagctcgtcatctttcggtaagcaaacaaagaagcatgtcgattctttttcttacatccatacttcattccgtgttttgcaagcgtggtatccaaatcttccataataagcggtttcttccgttcggcgcaataacgtcctacctttgccatcactcttccgatttcttctgaaatctgcccttttgttttcaattccggtgaaaagcgaatgactgtcccacccagacggtttcctttttcatctaattctgaaactgctacatggtcataattcaaatcaatcgaaacacagcctttttcaaaagattcattgcaatatttattttccagtaaaagcgtcaccgatacaatcagatatcttcgaccagttttctctcgtttcaactgaaaattataacaaatcgcttttcgttcctgtttttttgcctgaagcatttcttcccaaagttcctgttgccttgcaagatggaactttttaaataccgtttcttttccatccatacattttacaatcaaatttctttcttcttttctgaccagaaagttacagttttttgaagtatgacgtcctggaaggctcattgaagcatggcgagattcaaagaattcctgtttccactgttcacgatcgacttttggattgtcttttttttgatattgttttcttccaccaaatacaattctcttcggcagaaacttttttaaccattccagcctttgaatggctcttttcttagaagattccagtaatgcaattcttgttttcaatcgacgaatggaacgttctatttttctttcgtattcttcgactggaaagtatgttccattcggaagaaaaatttggtttcgttccattgtaattctacactttggataaggacgctcccagattccgcttttaaaataagttcgcaaagaagatttgattccctgcttcttttccaattcttcctgtgttcgttttatcttttgattccgtgtctcaatgtctttttcttttgttctctgatacaatcgattcaattccttttgagaagaaagaacagaagaagcataagtatagatggcacaattataatagtccgttgttccatagttccttttcagccaggagctgtatgtttcttctaataacggacctctttttaaaaaggatttgtcatacaagcagttatagagcttgattttgatatgattaaatcgttccatcgtctgaatcaaagactctacgttctggatttcatcctcatccagataataccgcttatctgcatttatcgttctggttaactgcatgaaaacactccttttctcaaaacagtttgtcggttgaaaatataacaataattgaaataatcctttatttatagtataattatagcacaaatcaagccgttttacaacatcggttattttaaagaaaggagaaatttatggacaacaaaacttataccagaaatgctcattccgtctgctgtctgacctatcatgctgtttttgtcattaaatatcgaagaaaagtaatcactccagaaatccttgcttttatgcgtagttacacagattacttaatttcacagcgttatcatggaaaacttttggaatttaatggtgaagaagaccacatccatatcctatttgaacttccgccatccgctgcaccttctgttattatctgtaatttaaagactcagctttcaaaggaagtccgaaaacgcttctgggaacaaattcacaatcaattatggaaagattctttttggagtgacagttacttcttatcgacaactggcggtgcaaatttggaagtattagaacaatacattcaacaacaaggaatcgaaaaacaaaaacggaaatacgttcatcacaagaaaaaatgagcattcatccccaaccgactcgtcggatggggatgaatgctctataatagataaaattacggcatataccagataaaatagtgttataccaattccctgctttaaattttctttaaaagaatgccagaaagcaattgtgacagtactatgttttttccttacaactttaacaattgtataataaagtgctgcacttgccggtcctatcgtaataatcggaatacatgctatcagccacaaaaatcctgcaattatcacttctgaaatctgttctgcgattgacacaatcggagagtcctctgataatttcaccctcattcctcctgttttttctcattactttattttatcatttttctaaaaaagctaccattggaatctatccaaaggtagctttttttactttttacttaatcgcactatctacctgaccttggataaaatatttttgcaggcacaggtaaacaataatcaatggtaacataccgattactgctgttgctgctgctgcaccataatcatttgatactgctgagaagaacgttttaatgaccaacgtaatggttctcatggatgtcttctgcaggaaataatatgcataagtatattcattccatacactaactccttgaaggataataactgttacagttacagttttaagctgtggtaaaataattttaaagaaaacctggaaattacttgctccatcaatggcagctgcttcatcaagcgcaaccggaattgatgaaataaagttcgtatacaagaagataacaagtagaagtccaaatgcacttatgttgttagacatctttttttctttttatagataaaatttaggggaggcagatgaaccgtttcgactcatctgcctcccctattagaactgtcattaaccgacagccccattctattacttcgaccaatatcttttgatcaaccgcaacatattttcacttctatacttccatttttttcatttcttccaggaaatcacgaatataagctactgctaaatctaaagcttcctgtcccaactcagctgaagattcctttggatcaaaaggaccaaaccaaccactcggtgcgatttctttagtatctcttacaagacgcacaattcctcccttaaaattgaccgcctgaatgtaagctgctttcatattttcggtcggatcttgagcattaatcggcttgctcagttccagatgcacagaatccggagcaattgccatcattgcagaagtttccagaacatcaccatgaccaccttcaaattttttgtctaactgagctaccagactccaccaatcaacgcttgcacatacaccacctttatgatagacttcaagcgctgcacgatcaatagacggtgtatttccgccatgaccatttaaaatcacaaagcgttttgctccatgctgcataagagaatccataataccatggagtaccaaatacaatccttcatatccgatattgatgcttccctcaaaactcaaatgatacgggcaaacaccatacggaacggttggtgctacaattacattttctacatcttccacgtgatctgccagataagacggaaccatgaaatctgttccaagcgcactctgtgtaccatgctgttccgtgcttcctaccggaatcacaataatcggatcttttaaaaaggcttcctttgcctgtactgttgtcatttttgcaagatacattctctaattcctcctatcatgctataccataaaatggcgttcaattgtctcctgtggcggagctttggtaaatttacttacaataaccattacaattgctgaaatgatcgttgttggaaacaatgcatggaatcccaaagcaagtgcttttaccgatggatttaaggtaaagagtaacaatgagatcacacctgttactactgctgcgattgctccctttgcagttgcttttttccaataaataccaaacaaaatcggtactacaaaaattgccattcctgagaatgcaaataagttaatttcaaagatactacctggctggaatacaccaaagcagattaccaaaataccaattataacggttattactttagaaagcttcataacactttcatctgtcgcatttttattaacgagtttttggtaaatatcacgggtaactgcaccggtagtcgttaccaaaataccatcgatggtagacatacctgcggctacaatgccggcaataaaaatagaagctaaaaatggattcaaacctctttgcaaaatcattggaacaatctgatctgctttctcaatattctgaattgtagcaattccgtttacaccggcccattcaatcagagttgcagagaaaaacatacctgcagtacccagaaggattgctttaaacattgttttatgatctttcattgcaaaaaacttagtaaacaaatgtggctgtcccattgtaaagaaggaccacaacacaatattcgatacataatatgtccaaggcatataaccatttgcacctggaaacgtcagataagcttcattcatactatggagcgtttgattgatattagagaaaccgcctcccattacgatagaaaccacaaatgtcacgattgcggtcgcaatcatcaaagaaccctggattacgtctgtcatcatagcaccctgcataccgccggtcatacagtacaagatcacaataattcccattccgacaacgcctacccattcaggcagtccggtaaatacatgtacaataacacctgctccgataatctgtgctcccatcatcggaatcaagaaaaacagcatcatgataccaagcacaccactcataactttcgagtcataacggtctgtcagataatctgccattgttaagaaaccatatttgtgtcccagcgtgattaacttacgaccaatcaaaagcgccggcaaaatcatgcaaaatactgcacccggtacagaaattgccattcctgcatatcctacgccataaattgttcccggagttccaaggaatgttcccatagaaaactgagtagagaaatatgcgataccactcactactactcctgcttttccgcttaagacaaagaaatctcccaagctgttggtcttgcgtcctgcataccaaccaataaatgccataattccaagataaagtaccaacaccgtataaaaaggaataggtgacggctgaattgctgctccattcataattactttttctcctcctcatcataggtgtgatattcttttcgtttcatacacatgcgataatattttataatcagcgcaaatgtaattgctgtgtgcacaaaccatccaaacaaaaaaagcggaatcccaccaaatgcagggatatatgtctcgctataaaagaatgggaacggaatcataaggattacaaacataaataagaaaataatcaaccaagtccgttcaaagtgctcttcaaactgctttttcatagttttgccctcctcttttttcaatttctttcagttaagcatatactttactttctgttttttattatacatgctataatagttttgtaaagtcatcacttacatttttgttaaatatcacgaaacttttttaaccctgacgacgaaaggaaactctatggacattttagaacatattcaggaattatatccaaatcttaccaaaaagcaaaaatcgatagcagattatttaactgctaaccctgaagaaatcagttacattactctagcgcaactcagtcagcaaactcaagtatctgaactaacgcttctgcgcttttgccaaaaacttggctgttctacctttgtaggtctaaaagaacagtttcgagattatacccagagaatgattcgtattgcttcctcctcttcttactttattccggaactggagaccggtgaagcacctgagcgagaacgcatacttttaaaaatttgcaatcatgaagcaagtgccttttccggctttatttctgatttacctttcgattccattatcgctgcttctgatgaaatccgtcgcagcaatcgaatttttatttttgctcacgatatttctaaagtacctggcgaatttttaaaatctcgactcctaattttgtattttaatgcaattttaattgatttatccgatttagaacaaacacaaaaaactttacgtcagcttaccaaaggagatcttgttatcttcttctcctttccacgctactattttccaattggaaatattgcaaaaaaagcctctgaagccggagttccgattttaacgattacggacagtgatgcctcacctgctgcttgctatagcaacttattgctcatttgtcctacctctacagagctgttttacaattcaatgacaattccaattgctatgctaaatattttagcatcctgccttgtcattgacattatttcaccagccgaacgacaaagttttatcgacacgttatcttcttaaactttttaaccaaatcaagtaagtcccctgcttcaattgtgaaaagcaataagcaggggtggggacttgcttgtatcatgagggggcaagtcccttctgataagctgcgtagcagctatttggttatgagcaagtagcaaagcggattgcgaatatccacttgactctctttaaaaaacggagacatcgattcaaaattccaaatcgatgtctccgtttttcattatttttcataagtgcctttttgaagaatctttccctctttcataaaaagctttccattagccacaaaagcatccaactgtaagtctttatcaaaaagaagaatatctccatctgcgccttcttttattaaacctttcttcggcaataaatcaagcccctctgctacctgactcgtcatataaggcaacgcctcctcaagcgacatttcaagttcttctatcatatactttaattccttataaagcgcatccacaccagaaacaccaatctccaaaagtgttccatcttctgcataattggaccaacttccatgaccatccgaactcatagtaatgtgctcggtagaaattcctctcctctttgcttctaatacacacttacccggagaggtgtgcataccgcaagtcaaatccacatatccgcctttttgcaagagttcatatccttcttccatcaaatttttattacgatttacatgcgtcggtctaaaaattcgcaccggaacagaacttgtgtccaatgcttgaaaaaccggctgcaaccctgccttgtcatctcccatatgaagtacaacgattcctggttttccgctaagcattcctgctactctagccttactggcaatctgaatcagctcgtcttctgtcacattcggtgcacgatgatctgaaatagcaagcttcacacccaaaatttcttttacaaacacaatatctctgtcgatttccccagtaatcgtcggatttggaatcccataagctccagtcagcatatatgcacttaccccttcttcacaaagtgctctggtttttgcatagagattctctacacttcttgtaattccatcggttcctaaaagccctactaccgtagtaattccattttctaccagctcagaaagctgcaattccggcgttcttgtatgaaaacttccttctccgcctccgcctgtgatgtgcacatgctgatcgatgaatcccggtgtcaaaacttttccttttgcatctaaaacttcacaatcaatcggcagcggaccaatttcgtcctgaatcttttcaatttttcctccacagatcagtacatctttttttcccaaatattttggcgcatatacttctgcattttttattaatagcatctcttaccctcatcttttctttttgcttttcacagttccaaggaacatgcatcaatttttttcaattcttcttcactaaatgatgcgctgtttaatactttcagattttcaagaatctgctccggacgggaagctccaattaaaacacttgttacaataccgtcacgcaaaatccattttaatgccatctgagcaagactctctcctctatctgccgaaatcgcatttagactgcgaatgctttccaaacgttcttgtgtaaactgcttcgcatgtaagaatcgtccatctgtatttacacggctatcttttggaatcccatttagatagcgatttgtaagcattccctgtgccagtggactaaaagagatcactccttttttctgctctgctgctgcttgctttaaaccatttttttcaatttctctgttaaaaatattataagaattctgattaataataaacggacaatgtagttcttctaaaatttttgccgcctgtttcattgtctcaccatcataattagaaattccgacatagagcgcttttccgcttctgacaatttgcgccaaagcttccatagattcttcaagtggagtttccggatccatgcagtgatgataaaagatatctacatattctaatcccatacgtttcagactctgatcgaggctggcaatcaaatatttccgactgcctcctgttccatacggtcctggccacatatcataacctgctttggtactgattacaagctcgtctctataagcataccactcatttttcaatattttaccaaaattttcctctgcacttcccggttgtggtccataattatttgcgagatcaaaatgtgtaattccatgattgaatgcagtaaaacacatctgtctcatattttcatagacgccagtatctccaaaattatgccataatcccaaagagagttccggaagcataagaccgctggtaccacagcgatgatatttcattgtttcatagcgtttttcgtttgcctgatacatctttcttctctcctgatttttactttactttatagtttatcaaaagatgaaagaaattgatagacgttttctgccgatatttttactttctctgctttctttataattctgctccgtttgtctctattacatgtttataccaaaatgctgagtctttcatgattcgtcgccaatacctttgccacctggtaatccacatcattttgatattgattattataacaataaaagattgcaacgaaatttaggagtattaactccaatagcaaaatacaaacaatatatgttggtagcataaaaaaactgccaccagattcaaaactggtggcagaaataactttttatttttttaattgtctacttgacgggaagcagttcaatctctgctctttacactgtcttttcttctgcctttactatgcccttaaatatagttttaatgtcctttcaaattactttcttatcaggcattagcaaaaggagctccttttttgtttttacatatccaaatgcactgcaccagtctggcgaatctgcatcacataaatattttcttctcccatataaggagtcatcatctccacatatttcggtgttaaatcttttggaagcactgctgcaatgacacctgcaaatccaccgccatgaactcggcagtatcctcttccttcttcttcgataaataattcggtcagcgcaagtgcaaccggaactgcctgttctgtctcatcttttgttgcaaagcagttctgtaaccatttccaggaggaatttcctgattttgtaatgcagcttaagaaggttgcataatcttcttctttgattgcttttactgcagtatctactcttttttgttctgcaaagaaatgcagggcacgcattactgcacgatcaccggcttcttctcttactttattaagatttgccataaattctttttcgtccacatccgcaagcacttcttttccaaatacctttgcggcacgtttcatttcaaccggcactgcggaatattcttcacttaagtctgcatgaccttttcctgtatttacaataattaagtcatatcctaacttatcataaccgaattccactttttctacttttggcatttcctctttgaaatcaatcgcaatgactccgcctactgcacatgccatctggtctaacagtccggactgttttaaccaatattcatgttctgcatactgtccgattttcgcatattcaacataatcaatttttccttcattgctgaagtagttcatgattgcgcaaatcagcatttcaaaagacgcagatgaactgacaccggctgcaccgattacctctgttgtgatataagcatcaaatccttctactttgtatcctttttttatggcacattcaaacataccgattaataaagataaggttcctttgcatttacattcagaatccagattttccaaatcaatggtaattgctttgtatccctcactgattacatgaaccagagaagttccgttttttcttgctgctgcaatggtatccattgcaatgcttgcagttaatacttttccatgattatggtcggtatgatttccaagaatctcggttcttcccggtgcactgaagaaatccacttctccctcgccaaaacattctttaaattttgttgccagatgttcatatcttgcctgttccttcgctaagttttcttctccataaacactgctcagtacgcttacttctttttctgattcaaacattcccatttttttaccttcctttattgtatttttcttttctttacgttcacacttgtaagttttgttacttgtattataatggagttatagacactaatacaaggaatatcatggggattatatggaggatattgagattttatgcaaatacagacgaatcgaaaccagagggaattaaaaagccatggagatgtttctttcccgattctggtcagccatgagagcatcacatcttatgagttaaataccttttcctggcactggcatcctgaaatcgaattaacattaattgaagagggcgaaatgatgtatcagattaacggacatgaaatgcatgtccaaaaaggagacctactgttttccaactgcaatgctctgcacagcggtcactccattgacggaagagcctgctactactggagtattacttttgattcaaaattaatttatggatttgaaaacagtctgattcagaccaaatatgtcgatgccgttgtaagtgcaaaagaattttcctctcttttattggatggcagtgaatcctggcatcacgatttaaaagaactggtctgtgaattgatctccctttcctccgataaatccgatttttatgaaatcaaaattcaaatgcagcttacaaaaatctggctgatgctcctcgaacacagaacctcattttctttaaatgaaaatgctctgaatccgaaaacatcagccagattaaaagccatcttaagttttattcacgaaaattttgaaaagaaaatctctctcgatgatattgccaactcggttcatttatgtaaaagcgaatgttgccgtttttttaaaaaacacatgcaggaatcactttttgattatcttctgcgttaccgaattgaacaaagcattccttatcttaggaaccctgaatattctatcaccgaagcagctctttgctgtggctttagtgacgccggatactattcccgcatgttcaaacgctataccggaatgtccccaagagattaccggattggtctgtttccggattacgacaggtaacccctcatatgtcattattttctttcctacactttgtaggaaaactttgaatttttccccactttctgcggcttgttatttctctctaccctgctaaaataataaatataaaaagcaggaaacgaaagggaaatccttaattatattgtttcaggaggtgtttcatttgattattattggggaaaaaatcaatggttccattccatctgtagcaaaggcaatcgcagaacgtgattccgaatttatcaaagaacgcgcaagaaaacaggctgctgcaaatgccacatatattgattgttgtgcatctgttccggaagccgaagaagtagaaactttaaaatggatgattgactgcatccaggaagtaaccgatttaccgatttctgttgacagtccaagcgctgacgttttaacgcaggcatataaattctgcaaacgtcccggaatctttaattctgtatccggagagggcgataaaattgacaaaatctttcctcttatggcacaggaagaaaacaaagactggcaagttatcgcactgttaagtgatgataccggtatcccaaaatgtgcagccgaccgtcttcgtgtctttgacaaaatcatggcaaaagccaaagagtataatattaatccgagccgaattcatatcgacccgttagttgaaatgctttgtacttcagaagacggaattgcaatgaatatcgaagtcatacaaactgtccgaaaacagtatccatcaattcatattacagcagctgtcagcaacatttcttttaatcttccggttcgtaaactgattaactacggatttttaattcttgcaatgaatgcaggtcttgacagtgctattatggacccaaccaatcgtgacatgttaggtcttacttatgcaaccgaagctttgcttggcgaagatgaattttgtatggaatacatcggagcgtacagagaaggcttaattggtccattaccaaaggcttaactctaaacatttgaaaatatattggaaatttaattcaatcgaaataatagggaggtatcactatgagtaaacttcaagatgttgaaaatgcagttgtttccggaaaatctaaattagttgcaggtcttgttcaggaagccttagacgaaggatgttccgctcctgatattttaaatggaatgattaatgcaatgggtatcgtcggtgaacgtttcaaaaaaaatgaaatctttgtacctgaaatgcttgtcgcagcacgtgcaatgaaaaaaggcgtcgatgtattaaaacctcatcttgcttccggaagcgctggtgtttgtggaaaagcaattattggaactgttgccggtgaccttcatgatatcggaaaaaatctggttgccatgatgattgaaagtgctggatttgaagtcattgacctcggagttgacgttccggttgaaaaattcatcgaaaccgttaaagcaaatccagatgttaaaattgtcggatgttctgcacttcttaccacaaccatgcctgcattaaaatctacagtagaagccttaaatgcagaagacttccgctctcacattaaagttatggttggaggtgctcctatcactcaggaatttgcaaatgaaatcggcgcagatgcttacacaccggatgctgcaagtgctgcacagaaggcaaaagaactggtagcttaatttctatttgatgtttgtcatttttaatccttacactttaccaaaagaggctatgtactttcatggcctctttttctacttttactgcctagatagatttactgtttttttaatttctgctataattgatacaaaatgcacgacaatttcaaccttatttattattttgacatttattgggggaattttattgaaactttttaacattcactttatcaatgaaaatcaagtaatccaggtaccagaaaatacaaccctgttagaagctgaaatcaaagcaggacttataccggatgccccctgcggaggtcagggcacttgcggaaaatgtctggttcagataagagttcaggaaaaatccgaacttgtaaaagcctgccagacaaaagttcattcagacatagaaatagaaactctgaaacatacttcaaagcattccattctccatgaaggtttttcccgtccggttcttttaaaacctgccctctcctgtcatgcaatcaaattagaaaaagcaaaacccggagaaaatgcttctgactggcagcgccttactactgcactcacaaaggtttccgcaactgacatgagataccttgaacctgacttgacctttgtttcacaaatttatacgttgcaaaaagagaagatttatgccgtaacccttaagaaccatctgcttgatttaaaaaatgctcctgtcattccttatggtgcagcttttgatattggaactacaaccgtggtcggctatcttattaatctgaccacgggaaaagtttgcgctgttgcaagcaccatgaatccgcaggttcaattcggtgcggatgttatcatgcgtgcaaactatgcattagaacacggaaccaaagaattaagcagttgtatccagactgccattaacaaactgattggacagcttacaaaagaagcagagattgaacgaaatcttatttatcaggtcatcattgccggaaatacctgtatgcaccatctgtttcttggaatttctccggcatctctggttcatgcaccatacaatccggcagtcagtcagatgcttgatttaaaagcctctgatttttctctttctattcatccaaacggacgccttatcatgttaccggatattgcaggatttgtgggagctgacaccatcggctgtctgctctgtgtccgcccggatttaaaagaagaaatcacactcaccatcgatatcggaaccaacggtgaaatggttcttggaaatagagaacatctcgtcacctgttctactgctgccggacctgcttttgaaggtgctaaaattgagtgcggcatgcgtggcgctgctggtgccgttgaccatgtacactttgaaaacggtgattggaaatacacgacaattgaaaatgaaaaacccgtcggtctctgtggttccggattgattgatttgactgccgaactgttaaagaatcatctaattgattcttccggaaaattcatccagtccaaatcttcttttactttaattgaaccagatgaaagccggaattttaacggtgtctatctgacccagaaagatatccgcgaagtacagcttgcaaaggctgccattgcagccggaattgaaagtctggaacaggaacttggaatcaccgaagaccagatttccaaagtatacatagccggagcctttggaaattatatgaatccacaaagtgcctgtgaaatcggaatgattccatttcacttaaaagataaaatcgttccagttggaaatgctgcaggagaaggtgcaaaaatcgcattgattaacgaagaggaacttttatacgcagacaaacttgctaaaaagatttcattcgttgaacttgccgcatcggaagattttcaggactgctttgtcgacaatctggaatttcctgatttttcttaacacatatatgctctcggaatctttatctttgccgataagactccgagagtacataaatcgaatagaggtgtatctctcatgattaattacaaagaattagaagatatcggtcacaaaacgggatttacccacattgtaccccttgactgtaagaccattgaacttttacctgaagtccgtcagatgtgtcaggctgatacctgtcacatgtatgagaaaaactggagctgtccgcccggatgcggaagtttagaggaatgtcgtcaaattatcgggcgctacacccacggaattattgttcagacagtcggggacttagaagacgagcttgatggtgaaggcatgatggaaactgaacatcagcataaatctcatttttatgaaatggaaaaaatattaaggcaggtctggccggatatgctcgctgtcggagccggatgctgtacgaaatgcaagacctgcacctatccggatgctccctgccgttttcctggaaaatcattttcttccatggaagcctacggcatgcttgtcactcagatttgcgagagaaatcatttaaaatactattacgggtcctgcaccatcgcttacaccagctgttatctgctagagtgaacttaatacacaaacacaggaggaatttttatgactacacttgaactgctaaaagaggccatcgaagtcggacatccccgtgatgcacaggctcttgtctaccaatgtctcgaagagggcctctcctcctcggaaatcattgaccaggcaatgattccggcaatgaaatcagccggagaatactacaaaaataatgatgctgatatcccgcggattttatctgctgccagaagtgtgagaaaagcctatgatattttgcaggaaaaattcggttctctggaggatgaatcgcttggaaccattattcttggaactgtagaaggagatttacacgatgttggcaaaaatctggttgctttgatgtttcgaagtgccggattcaaagtaatagaccttggcgtcgatatttccgaaaaacaatttttaaaagccgtaaaagaaaatccggatgcctctatcgtctgcatttcttctctgcttaccactgcactgcctgaaatgcaacaggtcgtaaaatcattaagaaaacatgacccaaaacataaactaaaaattatggttggcggcggcgctgtaaccgaagaacttgcaaaacaatttggagctgacgcatatagcgacagtgccatagaagctgccgaaaaagcaaaaacttttattatttaacaagcaacggagcttaaattttatgaaattatctactgaacttctttttgaaaaattacagaccgaatttacaataaccgcttacagaaatttatcaagtgcggatggatttttgcgcccttttttatatgattccaaaccgcttatcgattcccgaccgatttatgaacccctcgataaatccaaaggaatcactccgggacacgtctgccttgcccacggaaaacgcttagaagaatttattcctcatatttttgaagaacattttttagttttaaccggtaccaggggcgacgttcaaaaactttcttctgctgtctttccttatgtcgttctttctgaaaatacctctttaagcagtgttttaaattttctgcaggacatctttgatttttatgatgactggagtaacgaattaaatacttttttattaaaaaatgatgatattactctgcttcttcacaatgctctcaaaatttttcaaaatccactttctgtaatcagcgtggatttttccctgattgccgagaccggagaagaaaaaatcccggaaaaatccagaattttttcagataaagaaccaaatattgattacatcaatgcgcttacacaggacgagacctatcagtctttctgtaacagtccgactccgtttttctttccaggatatatcacaggaatttctactctcaccatgaacatttttcaaaatggagttcctacccaccggcttatcctctatgaagcacaaaaacccattaccaggggcgaatattgtctgctctcccatcttgccggttatgttgaatatctgctctatcatcagcatattccgatttccggacaggcaaatgatttgcatcgtattcttcagacaacactttctgatagaagtgcagactatctcgatatcagtcatcagctttcttctcttggctggaacacccggcatgaatatctctgccttgtctatcagaccacctatcttgaccagaaaaatatgactacacgcgccatctgtaattacatggaaaatcattttccggactgctcttcttttttatttaaagatgaaattgtcacattttttaatctttcacttttacatgcaggcagtgatgaaattgcttcaaaactgacttattttatccgagacagtttcttaaaagccggatacagccgtgccatgaccggacacatgaatctaagacgtcagtatgtgcaggcgaaaacagcacttgatgtcggcagtcgaaaaaaaccttatgtatggattcatcattttaacaatatcgctctcccttatattttagagcaatgtacccgccgacttcccgcttctatgatttgctatgaaaatctgttaaaactccaggcacttgaccaggaacaaaactcggaatatgtgctgactttaaaaacctatctcgaacaaaatttaaatgccacgcagactgcaaatgaactttttatccacagaagtacgtttctctaccggcttgagaaaataaaatctattttagattctaatttagacgaccccgacgagattttttacctgaatctctctcttcgtctgctcgaacaggaagcagaaaaaaattaatgatccagatactttttttcttctcttcgataaatcgagagttccacatacagcctggatgcaaaatcatccaggtctaattttgtcagctccttgattcgttctaaccgattcaaaaatgtgctcctgtgaataaacagttcttttgccgtatgagccgcattataacgacatttcacataacattccaatgtcttataatactgtgtccccatctgtctgtcatgctccatcagcttttgcagtgccagggaatctacttcttccgaaagaaattcctccgctccatgcatcatcagatacatcaatgcatactcatcaaaccgataattccactgttccggatttctcttcatccccagttcaaatcctatctccgtctgtctgaccgcagacataaagcgttctgtcttggtaaattcacggctcgatgcggcagtcagcagattctctctcaaaaaataagcaaggtctgactgaaaatccaccattggacttcttgaagtatttaacaaaacatacagacctctatctgcaatcacacagcatgtatctttccatctgcgttccatttccggacaaagataacgttcaaataattccctgtctcgtctgcatttagaacgaagctcaatcaaacagaaatgttccccttttttccatccaacattttcaaatgcaacgtcccacttcttctccggacagctttttccatccagacattgtttcatcacccgatgtaattcatccattgacacatccgattgattaaaagaaccataacgtgcatacattttttctacataatctgcaagcagttccaataaatccttatgataatcgttttgcagtggagaactcgaagaaagtgctgtaagttttcctacataagccccttcaaaaaaaatgttcttacataaataagttccctgttctaaactataactatatacaccttttaatttaatggtgttttcataagaaaaatcacagataaactcactgacaaattttaaatccaatgcattttgagaatttttgaatggtacaaaatatccatctctgtccacggctgcaacataaacaaacttctcatctgtcagtgccaccggtgtttcaaaaatcttttcacagcaactcatcaagtgtgtaaaatcaagattttccataaacacatctataaccgatttttcaaacttttcaaaataaaaaaagatttcctgaagccggttgaaaacttcctctctttccacttctttatccagtatgattaaatctctatctgtcctgcaaaatatagtgtctacctctccaaaacagataaaaacacaatctttaagcgcaggagattttagcgcaattttctcaaatttctcattctccactaatacgatatgtcccgaaagattttctccttcccggtaataaagtggcttttctacaagaattttctttggattacaggaaattctgcgaatcgaaaataacttttttagatgataataaatttcgttaaatgtaagcttcatagtacatttcctccatactacaaagtgtagtgtcacaccctctaaaagtcaattatttcatcggatttacgatttcataaattcctgctatgataaaactatcttaagagaacgaagtcaaaaagtaaaaaaagaataacgaacgtaacaaataaaggaggtttttttatgttaactaaacgtcagaacttattagaaaccatccatggcggaaaaccagaccgctatgtgaatcagtatgaagcatttgctatgttattcaacaacccacacagcatgcatgaccctgctccggaatatggaaaaccaccggttaaaaatgcatggggtatcacaaaagtatggccggaaggcacacctggcgcattcccgattcatgatgaagaacacattgtatgtaaagatattacaaaatggcgtgaaactgttcatgcaccacgtctggattattccgatgccgagtgggaaccttttatcaaagaagcagaaaaaatcgaccgaaatgaatattttgtgacacagtttattgctcccggaatttttgaacaatgtcattatcttcaggaaatccagaatgcattaattaatttttatgaagaaccggaatatactcaggaattaattgattacttaacagaatgggaactcgaatatgcagaaaaaatctgtaaatatattaaaccggatgcactcttccatcacgatgactggggaagccagaattctacttttatttctcctgatatgtttgaagaatttattctgccatcctacaaaaaaatttacggctattataaatctcatggtgttgagctaatcgtacaccactccgattcttatgcggcaactttagttccttacatgattgatatgggaatcgatatctggcagggaaccatgagctccaacaatattccagaattaatccaaaaatacggagacaaaattaccatcatgggtggaattgacagtgcctctgttgaccgtccggattggacaccggaactggttgaaaaagaagtacgtcgtgtctgcgaagaaaacggtacaaaattctttattccttgtatcacacagggtcttggaatcagtaccttccctggtgtatacgagacagcaagcgaagtaattgataaaatcagtaaagaaaaattctaatctcttctctataccaaaaggacgaagcttcaaaagctccgtccttttttcgatacagatcatcaaacgatatcaacttaaatcggcatatttgcaataaataaatacatcacaataaaatggcagatacttccccccatcacaaacagatggaaaatttcatgagagccgaaatttttatgctttgcattaaataacggtactttgagtgcataaatcactccaccaacagtataaatgattccacctgccaacagccagccaaatcctgccggattgagtgcttttacaatcggaataaaagcaaatacacacaaccagcccattgcgatataaatcacagaagaaaaccattttggacaggtaatccagcatgccttcacaatcgttccaactattgctactgaccataccgcaatacaaagaatcgttcctgtttttccatgaagtgcaatcaggcagacaggagtatagcttccggcaattagaaagaaaatcataatgtgatccatttttctaagtctgcggtttactttctcagttgaatccactgtgtgataaattgtactcgctgcatacaacagaatcatactcagaataaaaatgctcatcgcaatcaggtgaatcttatccggttctcttgctgcctttaaaagcagcggggcagccgcaagtactgccatcacacatgcaataaaatgagtaattgcacttccagggtcttttattttaaatttcatacaaaacactcctctctattctgcaaaattatatgattagtattgtttattattttatgtagttttaattactacttgttatgaaatataatactacttattttctctttttgcaagtgatttttgagagaagtaatcgacttattttgacaaaacagaagttttaacaaaaaaagaagtacgaattgaagaatttcttcattccgtacttctttttttattacttcttatttcaggcttataaattatccaaagtatctctttaacagaccagcaaatgcttttccgtggcgagcttcatcttttgccatttcatgaacagtatcatggattgcatctaagtttgctgcttttgcacgttttgccaggtcaaatttaccggctgtagcaccattttctgctgcaacacgcatttccaggtttttctttgtgctgtctgttacaacttcacctaataattcagcgaattttgctgcatgttctgcttcttcgtaagctgctttttcccagtataaaccgatttccggatatccttctctatgagcaactcttgccatagccaggtacataccaacttcagaacattcaccttcaaagtttgctcttaaatctgctaagatatcttcgcttacgccttttgcaacaccaactacgtgttctgctgcccagctcatttcgtcttctttctgttctacaaatttgtcagcgccaacgccacatactggacatttttccggtgctgcttcgccttcataaacatatccacatacactacatacaaattttttcataactgttttctccttttttaatttgataatttatttttagatttttaataacaataattattactgttttaatataacatacttgactttttttgtcaactagtttttttcttttttaattcctgacttttgttttccagacactccttacagattccataaaatgtagttctatgtccgtggatttcaccatcaaagtttttggcaatccgttctgtaagacctgtcagatgctcatcttcaatatcaaaaatattatggcatctggtacagatgaaatgactatgcggttttgcatttccatcaaagcgatccggtccgtctcctgtcggaacttttacaatttcatctaattccactaagagcgaaagatttctatataccgtgccaagactgatattgggatactctttacgaattgacgcatatacatcatcagcagtcggatgctcttttgaggcttttacaaactctcgaatggattccctctgacggctgtatttcaatgtagccatcgcatttcataccccctttaattcttactttaataacagtaattgttactgtgattaaaatatatcatacttaacaattttagtcaagtatgtttttaaaatttttttcaattaatttaagcttgtcctttcttgcaagctgtttgatttcccactctcttttcattgcttcctgcctggtcaaaaatctttcataatagaccagctctaccgggcgtcttgcccttgtatactttgcgccttttccggcattatgattctgaatccgcttctccagattatttgtccaccctgtataaagactgtcatccttacaccttaaaatatacgtatagttggcactctcctgattttccatttcacaaattccttttatgtaatgggcactgacaaaacagcacccttctatttttaagccgccgattttaagaagtatttcactcaaaaaattttcacttttttatagtctaaattgaatcggctgcggattttcttttccgcatactttattatactcctctgtgcttcaaatgtgaatctttacacggtatttcctgttctgtttttatggcagatattccagcgggtcaaccgatactccatcctttgtcattgcaaaatataaattagaaccttctttgctgtagtacttcgtcggttcactcacataacccaatgttgctccggcttccatatagctttccggctcaaatgccgtatcttttaactgcccataaactgcctgatagccattccccaaatcaacagtcatggtaagtccggtttcttcgttatttacaacagaaacaacctttccatttgcaactgcaagcaccggtgttcccacgcctgccccaactgcaattgccggactgtagcggtattcatttaacgtcggaaaataaatcgtatgatccatgttataatccaaaagcacctgtccttctaccggccactgcatcagcgaactttccgtaaaattcacttccggtattgattgcacagcttctgtctgagtttcaacagactcttcttcctttatttgtgtttctatattttgctctgcctcgtctgtattttccgcttcttccggttcttctgtttcttcttccattactctttctccctctacctgtgaagtatttacatcctgtgtttctggatccttcgattctggattctgtgtttctgaattccggttttcttccgtagtttctttttcctctgttttcattgcctcatcaatggaatcgccctcatttaagacaaattctttttcatttggtacatttttacttccggactgataaaccaccgtacaagtacctgcaattactgccatcagcatcagtcctaaagcaagatgggttctgttttttcttctcatattttcacctcaacctatatggagcatccgccccttcttgttttcatctataggattgccaaaatatgagaagttattcatttttttgcatctctacttctattaattccaaacccggaaaaaaatagtttaaaatttcctgatactgcttgttttcctccgccatttttccagccgtccactggctgagtcccagtccatgtccgactcccctgcataaaaaacgaatcatttccttatctgtctgtacaataaaacaggaagaaggaagctttagaagttcacgcatttcttccccttgaaagtcctgattccctgcctgaatctccaacacataccccaaacgatctgtttctttgattttaatctccccggcatctttaatttcaaatcctgcatattctttttttattaatctgcgaaactcttttaactcaaaataacatccattgacataaaatggactcttcttatcctgaatcgtgtctacagaaatcaaataagcaaaattttcacccagaagttcctttccatctctgcttcgttctgttcccactgcataaaatggaatctgttttacctcatgattcaaagccagcacttttcctctcgtttcctctgctgattctaaaaatacatgaaatcgctctaaaaaaaatggaattcttcttttcgcttttaaatattttgctgcctcttctgctttctgcttttcttctcctttttcccactgcagataaaaatttccacgtgcaatcacagtctgcgccttaatgctctccttcggagcctcccagtctatctgcattgccgttaaaactgctatataatcttcaaaatccgtttcatttctgaccggtggacattctttgattcccaatatcaaggcaacaatcaaacaaggaagccctgccataaaaaataaaaggcatactccggattttattttctttttcataaatttataaaacccagacctcttttgtttattcttatgacaaaacttccctgtcctattcatattcttataatttcaaaatttaactaagcctcattatttttttataatcagtaccggaatcggtggattatttttgcggttgtaataagcactcacaatcaccagatattttttttcatcaaggctctttaaatacgctaaaagtgtatccctttcctcaaatccggtctctcctccgctgtaaatacaaagactcatcactccaccttttttaagcagtctcagaccctctataacggcgtttttactgctttcaggcttcgtagcaagagaatggtcacttcccggcaaatatccgaaattaaagcaaataccgtccacagaagcctcatctgcatactttgccatattttcatgactgtccagtatcaatcttgccttctgctccatcccctctgattttaataatgctcttgttgattcaagtgcctgcttctgaatatcaaatgcaagcacctgtccctctttccctgcaagctcgcataaaaacagcgtatcgtgtccatttcccattgttgcatcaatatacgttccgcctgtcactgcctgcattaaaaacaattcatgacaccattcggttatctgaaatgatttcataatgtcttactttcctccaatgcctgtgcaaggtcatcgataatgtcttctacattttcaattccgacagaaagacgaatcaatcccggagaaattcctgctgccttgagctgttcatcatttaactgtctgtgagtatgacttgccgggtgtaaaacacttgtctttgcatctgcaacgtgtgtcacaatagatgccagttttaagctgtccataaatttaacagccgcttctcttcctgcttttaattcaaatgaaatgactccgcaagttccttttggcatgtactttttcgccagttcatgatatttatcatttggaagtcccgcataatttacatgaccgactaactcatgcgcatctaaaaattctgcaactttctgcgcattataacaatgtctctccacacgaagcggaagtgattccagacttgcatttaataaaaagcagttcatcggagacggaattgaacctaaatcacgcattaactgtgcattaatttttgcaatgtaagcagattttccaaaatgctctgtatacacaataccatgataagattcatccggtcttgtcagcccatggaatttttctccataagcgtcccagtcaaactttccactgtcaataattgcaccaccaacctgcattgcatgtccatccatatattttgtcgtagaatgagtgacaatgtctgcgccccattcaaacggtttacaatttaccggagtagcaaatgtattatctacaataagcgggactccatgttcatgcgcaagttttgccattttttcaatatcaagcacaaccaatgcaggattggaaattgtctctgaaaaaacagctttcgtatttggctgaaatgctttttctaattcttctgccggtgcatccgcatctataaaagtacattcgattcccattttctttgctgttacgccaagcagattcaaggttccgccataaattgcagaagcacaaatcacatggtctccggcttcgcagatattaaagaccgcataaaagtttgccgcctgtccggatgaagttaaaactccggccactccgccttccagatctgtaattttctccgctaccatatcatttgtcggattctgaagtctggtataaaaatatccttcatcctttaaatcaaataagcgtcccatttcttcagatgtatcatatttaaatgttgtgctttggtaaatcggcatcattctcggttcgcctttccttggtttccaaccggaatgtaagcattttgtttcgatgtgcagctcttttcccatttctcatatcgcctttcttggtattatatttcttttattgtaccactttcagacatatcctgccactgacatcttatttttctcttaatcttacacagttatcgacaattatcgacgaaacttcttctgtccatagacaatcagacctacaaatacaacgattccaattgcaagaattatcagcttatttccgctgtctaatttattcatggaatctaaaaatccaagcaccatcatatcaatgccgataactgcaattgcaccacctgttgccatcataaattttctttcgttctccggtgacacaccttttgaaaatctctcacgaatcatacttggctttccccagataacaagatataaaccaatcactacaactactgcagctaaaataatcatcatcagacaatctcctctcattttcgctcactccttcccttatagtatatataagactcaaaaagtattttgaccctaacatcataatactgtaaaattaatatcaagtaaagaaaatataagaccaacgaaaggattgcctgattatgaaagaacaaatttataccattcctttaatggatgcttttaatgccggtgatgagtgcccattctgctttatcgaaagaaatctggaacagcatgccatggattttgtacttggcgccggtgcttcttatatggaagatgatatccgtgccgaaaccgataaagcaggattttgccgtgaacattataaaaagatgtttgaatatggaaaccgcttaggatgcggtctgattttaaccactcatttcaaaaagaaaaacgaagaattaaagcaacagataaaaatgttttctcctgcaaaagcttctatgttcagccattttaaaaaggctcagtctaccacggatgctccaaaaacttctatcggtgtctgggcaaaagcacagcaggaaagctgctatatctgtgactattataaaaatacttattcgcgctacctcgatacgttctttgaactctatcgaaaaaatcctgaatttgtcgagcttttcaaaaaaagtaaaggattctgtctcccgcattttgctgatttagtcgaaaatgcagaaacaattttatcagacaaagaaaaatcggatttttatgaaacgttattcccactgatgaccgaaaacatgcagcgtgtcactgacgaccttgaatggttctgtgacaaattcgattataagaataaagatgcagattggaaaacttcaaaagatgcaattccaagaggaatgcaaaaagctgctggcagctatccagcagatccgccatacaaatcggctttatagaattttagatgctctggcaacgtagtttccgagcagttcagaaatgacacgcaaaaaaacaagagccttgaatcttgaggggggatagattcaaggctcttatttttcacgtctactttataaaaaagaaggagagccgatataagggaaatatcggcatatgaaaaagaaaaagatttttgaaaaaagtcttattggctttgttcaagtaataatatacacagaaattgtgatgattttgtgttcaaataatgaaagaaatatgaaaaagtattttatactttttttatgaattggtattaccgatttgttttttgcttcttttagcgcatgagatgcaattttccttgcaaaaacgcaacaaaaaaagattgaaacctcttatcaagatttcaatcttttaagcagtgaagcatcggggattcgaaccccggacaacttgattaaaagtcaagtgctctaccgactgagctaatgctccatatttcaataatttcatcctgactattcgcaggaaaaatgcccagagccggaatcgaaccagcgacacgaggattttcagtcctctgctctaccaactgagctatctgggcctaataaaattaaattgagtagcggggacaggatttgaacctgtgaccttcgggttatgagcccgacgagcttccagactgctccaccccgcgttattaatttaaaagccgatgatcggactcgaaccgataacctgctgattacaaatcagctgctctgccaattgagccacatcggcataaatcaatgaatagaatcgcacctcatcggtactttcaatgggcgatggtggattcgaaccaccgaaggcgttgccagcagatttacagtctgtcccctttggccactcgggaaatcgcccatattaatttttaaaataaatgggacctacagggctcgaacctgtgaccctctgcttgtaaggcagatgctctcccagctgagctaagatcccattattcttttcgtttcctttcggaaacaacgacccagaagagactcgaactctcgacctccgccgtgacagggcggcgctctaaccaactgagccactgggccttatgaagaatatatcttcaaaactacatatacaaaaccgaaaccatgcagacacttgccgctccactgatttctcagtttctggtcaagccctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctcacagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcctttggattgccacacggtttttcctatgtgactcctccttcgcttgccctgggattccattcccaggatgtgctttccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtatcaaatacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctttagcgcttaaccttgccagcatgcacaactcgccggaccgttctacaaaaagtacgcggttccgcatgtaaagcggttccacagcttgtaaacacagggtttcaggttctctttcactcccctcccggggtccttttcacctttccttcacagtactatgctctatcggtcactaaggagtatttagccttacggggtggtccccgctctttcccacaaggtttctcgtgtctcgtggtactctggatcctgccttgtcctctttcctttcccatacggggctttcaccctctctggctggctttcccaaaaccattctggtagaatcaaggaatcaattttgcagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagatatctccggctcattggatatttgctcctccccgaagcttttcgcagcttatcacgtctttcatcggctcttagtgccaaggcatccaccctgcgctcttttttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacataaagatgcgagcacatttgaaaattttaaatcttctttctcacatctggctgttttatcagccattcaaacacaaaaactttttatgcttgaatcactggtaaaaccagtttatcctcatcagcacttccctgctgttttaggttgacactttcgtgtccgttctattttctaggctttttctttccccagcctttttttaagggattccggcagccacctgctttcccatgccgtctccagcatagtatcatcggccgcttaagtcttaaccatcgtgttcgggatgggaacgggtgtttcccctaagcgcatcgccaccggaaatatgttgttatctgttttttattgataactcaacagtgaaacacttacgactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcctccaggttatccctggcagtctccacagagtgcccagcttcacctgctggctactgaggataggggttgcgctcgttgcgggacttaacccaacatctcacgacacgagctgacgacaaccatgcaccacctgtcttctctgtcccgaaggaaaggtcccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgaaatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacactgtatcatgcgataccgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactgcttggctatctatcccttttactgttttggtttattgaaccgttctttttttaataaatgaatgtaaaagaattttcgttttcatgtgtttcactgttcagttatcaaggttcctgtcgttctttttatcagcgacagctcttatattatatcaaagctgtttttgtttgtcaagaacttttttaacttttttcaaagttttttattttgacttgttgtcgttttctgcgacagctataatagaatatcacatctttatcagcttgtcaacagtttttttacttatttttttatttctaaagagaaacaaaaaataagaacggagaaagagggatttgaaccctcgcacggcgcaaaccgtctatacccttagcaggggcacctcttcagccacttgagtatttctccattgcctgaataacaaatcattattcaattttgctcaactacgtgagcaatgactattatatctaataaactattaaatgtcaatcactttttttcatttttttcaattattttttcaatccgtatttttacttcttttgcaatctctacagacttcatatccttgtattcttcataacggattggttcaagaaaatgcacttgtactttaatcttttcaattgagtttacatcaaacggtttataggaatcaattaacgcaaccggaacaataggacactgtgctttcattgcacacttaaagcttccacctttaaattcatttacatgattcggattctttgtacgagttccctctgcaaagatcagataattccttccggattttacttcttttgttacctgtaccataacccgcattgcctgttttacatcttctctgtccagtgcataagctttcatacatgcaaaaacctgttttaaaaatgggatattctgaatttcttttttcatgactacagaaaacggtgtcgggcatgcatgtataattgcaagtacatcaaataagccctggtgatttggaaagaacataaatccgttttcttttggaatattttcctgaccatgaatttctatctcaactcttccacctttaattgcccgctcatcgatatagcgaagcagttcgtatctttcttcttcggtatacttatccgtatgatttgcataataacaaagtttataccacatatacggcactcgtaaaatattatacagtaccattaaaataattctcttcataatatctttcactttctttaactacaccaaactactgtaaaacaaactccccagcaaattgatttcactgaggagcacctgtttttaagtttctgtctgttctaataagtttgtaagttcttcttcataagacggattttttctcgtaaactgcttataatccttttcataagttttatattcatctgtcttcatgaatttctgaaattcttttttggaattttcactcatttcctctgttacatctttcgcctgcacaatcgaatactttttattgttattttgaacatagtaaacagacaggcatggaatctccaaagtagttttactttctgaatcctcttttttcagtgtataaatcgcatacatcaactcatatccattaaaagaacctaatgattcacattttgtaaactttacgctctttgcatcataagcttcaaacaatgtcatataatgtttgatttctgttttcagttcacttgaaactttgtcctttttatccataccaaaacatttctttactgcattttcatctgttttggtataagcctctattaatgactttgttattttttcaggggattttgtatttactttcgttccacatccgcctaatgacaacagtacaatgactgctgtcatagacagaagaatccctcttaattttttcatcataactctcctcgtacttatcgtacttatgcactctattcttttgctgtctcagtttcttcttccgtttcttctgattcctcttctttttctcttacttttgcaatacttgcaactgtaatatcatttttcagattcatcagctttacacctgaagtaattcttccaagaatggagatatctttacattccaaacgaataataatgccttctgttgtaatcagcataatttcgttttcttcattgaccgcttttacaccaactacatttccggttttttctgtaatcttataacattttacacctttaccgccacggttttggcaggtaaattctccaaccgaagtcctcttgcccattcctttttcagagacaatcaacagataatctccctgacagcttaactgcatgccaatcacttcatcttcatcctgaagattaatgcctcgcacacccatagaaactcttccggtctgtcttacatctgactcatggaaacggatgcactgtccgaattttgttacaagaatcacatcttttttgccgtctgtaaatttaacttcaatcagttcgtcatcatctcgaagagaaattgccgcaagtcccgtttttctcacattgctgtaatcctcaatcggtgtctttttgacaacaccttttctggttgccataaacagaaattctccggctttgaattcattaaccggaatcaccgctgtaatcttctcttctgcctgaagggataacagatttacaatcgctgttcctctggctgtacggcttgcttccggaatctcataagctttcagacgatacacacgtcccatattcgtaaagaacatcagataatggtgagtcgttgtcatcaacagttcttccatatagtcgttatgaatggttgccatgcctttgattcccttaccgcctctgttctgactgcggaagttatctacggtcatacgtttgatataacctaatttggtcatggcaatcaccgtattttcttttggaattaaatcttccatggataaatcatattcatcaaaaccgatggatgttcttctgtcatctccgtatttttcagcaattaataaaatttcctgtctgataacacgaagcagaagacttctgtcacctaagattgctttgagttcacggattttattcaccagctcatcgtactcaccctgcaggcgggcacgttccagtccggttaatgcacgcagacgcatgtctacaatcgcctgagcctgaacttctgtcagtccaaatgcagtaatcaatccttctttggcttcctgtgtatttttacttgcacggataatacgaatcacttcatcgatattttccagtgctttcaaaagtccttctaagatgtgggctctttcctgcgctttatttaaatcatatttggttcttcttgtaactacatcttcctgatgctgtaaataatatttcagcatatccagaagattcatcactttcggctcattatttacaagcgcaagcatgtttaccccaaaggtatcctgaagctgggtatgtttgtataactgatttaaaataacattcgcatttgcatctcttctcaactcgatacaaatacgcatcccctctcggtttgagtggtcgttgatagaagtgattccatcaatctttttatctcttaccagttctgccatcttttcaatcagacgcgctttatttaccatgtatggcagttctgtgacaataatctggctcttgccgtttggaagtgtctcaatatctgtgactgcgcgtactctgatttttccacgtccggtacggtaagcttcttcaattcctcttgttccaagaatcatagctcctgttgggaaatccggaccttttacgatggataaaatttcatccatcccggtatctcgatcctcttccacatagttgtcaataattttaacaaccgcagaaatggtttctcttaaattgtgcggtggaatatttgttgccataccaaccgcaataccggaagttccgtttactaaaagattcgggtaacgggacggcagtaccaccggctctttttctgtttcatcaaagttcggtgcaaaatcaactgtattcttgttgatatctgcaagcatttccatggaaattttactcagccttgcttctgtataacgcatagcagctgcgccatcaccatccacagatccaaagtttccatgaccgtctacaagcggatatcttgtagaccagtcctgagccatgtttaccaacgctccataaattgaactgtcaccgtgagggtgatatttacccatcgtatcacctacgatacgagcacattttctatgtggcttatccggtccattattcaattcaatcattgaaaacagaattcttctctgtaccggctttaagccatctcttacatcgggaagcgcacgagatgcaataacactcattgcatactcaatgtacgactcttccatttttttctgcaggtccacctcgtgaactttatcaaaaatattatcttccattcgtctctccttaactctgtttaagtcaatttaacatcatatgctgaccagaatcacgcaccaagtctcacagacgttcgacttgaacaatctattcacgcatcaaacttaaatatcaaggttcttgacatatcttgcattttcctcgataaactcacgtctaggctctactttatcacccataagtgtcttaaatgttaaatccacttctgaagaagtttcttcatccataacaacttttaacaaaatacggcgttctgggtccattgttgtctcccataactgctctgcatccatctctccaagacctttataacgctgtatacgattattgccgtcacgtccgatttcgttaagaatctcatcctgttctttttctgaataagcataatacacttttttattccgttcaatcttaaacaaaggtggctttgcaagatatacatgtccctgtttaatcagctccggcatgaaacgatataaaaatgtcagaagcagggttgcaatatgtgcaccatcgacatcggcatccgtcatgataatgattttattatatctgagcttgctgatatcaaaatcttcgtgaattcctgttccgaaagccgtaatcatcgctttgatttccgcatttgcataaattctgtccagacgcgctttctctacattcagaattttacctcgaagtggaagaatcgcctgagtcgcacggcttcttgcagtctttgcagaaccaccggcagaatcaccctctacgatgtaaatttcgcacttagacgggtctttatccatacagtctgccagctttccaggaagagacattccctcaagtgcagtttttcttctggttaaatctctggcttttcttgctgcatctctggctctctgtgaaagcacagatttttctataatgatttttgcaactgcaggattctgctctaaatagatctcaagctgattggctacgatattatccaccgcacctcttgcttcgctgtttccaagtttctgttttgtctgtccttcaaactgagggtcttcaatcttgacactgatgattgcagttaatccctcacgaatatcttcaccggaaagattcgcatcgctgtcttttaataatttattctttcttgcatactcattaaaggtttttgtcagtgcatttctaaaaccaactacatgcgttccgccttccggagttgtaatattatttacaaatccataagtgttttctgtgtaggaatcattatgctgcattgcaacttctaccataactccgtcttttgttccctcaaaatataaaatctcttcgtaaagagctgtagtacttttatttaaatactgcacaaattcccggattccgccttcatagtgaaaaactgtttcttttggttcttccccacgattatcttttgcaataattttaagaccttttgtcaaaaatgcaatttcacggaatctgtgtttcaatgtatgaaaatcaaatacggtctcctcaaaaatttcaggatccggatggaacgtaaccattgttccggtcttttccgagtcacaatccccaatgacttttagtttataaatagtttttccacgttcataacgctgacggtaaattttaccctcatgataaatcgtaacctcaagccaggtcgacagtgcatttacaacagatgcacctacaccatgcagaccgccggatactttatatccgccaccgccgaattttcctccggcatgaagaattgtaaatacaacctctaccgcagggattcccgctttatgattaattcctaccggaatacctcgtccattatcaataaccgtaatcgaattatctttgttaattgtaacttctactgtatcacaataaccggccagcgcctcgtctaccgcattatccacaatctcatacacaaggtgatgcagacctctggatgaagtactgccaatatacatacccggtctctttcttactgcttccagaccctccagtatctgaatctggtcggctccatactctgttttaatttctgtgttcatccaattcctcctgtttccctgatatcagttaacgatggttccgtctactactttgaaaagtttatttatctcaaacctgctgttcacaaattcatccagacccgtacaggtaatcatggtctgaatatttttgatgctctccagaagataattctgcctgttcacatcaagttctgataatacatcatccagcagcaaaatgggaacatctttaatttttctttctaccagatgaatttctgataatttcaatgacaaggctgctgtacgctgttgtccctgagaaccgtattttctaatgtcgatatgatttattttaacacacatatcgtctctgtggggacccgatgatgtgtttttaaatttaaaatctttttctctgtttttaagcagtatttccagaaactgttcttcttccacattgggctcataaatcagctcaatctgttctttttctcctgtaatactgctatgtatccgctgtatcacttcattcatctcacgaacaaattcacgtctgcttcgaattaccgaggctccatagcgaacaagctgttcgtcccagatatccagcgtactcttaagactttctttttgtgcaatatcttttaacaatttattgcgctgatttaaaatgtgattgtactgaaacaaatccgacaaatagattttattaagctgacataattctgaatcaagaaatctccggcgctcacctggaccattttttataatatttaaatcttccggtgagaaaaatacaatattcacaatccccagaagttcttttgctttacggattggaatcccgtcaattgcaattcctttcgctttattttttttcaaatgcatatctattctgtgggaaatgccccctttgtttattctgagcttgatatgcgattcattttcatgaaaccgaatcatctcacggtctttacttcctctatgtgactttgttgttccacaaagatacacagcttcaaggatatttgtttttccctgtgcattgtcgccgtaaaaaatattggttcccttgtcaaaccgcaaagataaaaactcataatttctaaaatcctttaattccattgattcaatatacatctgtacacctgtcgctatttcacaattttaatttcctgtccatcataagctacaacatcaccgtcatacagtttcctgcctcttcttgtatctacttctccatttacggttacaagaccatcctgaataacgtattttgcctccactccgtcttctactagattagctgcttttagtgcctgacctaattttataaattcatctcttaattttataatttccatgttttgtcctttctgcgttaatacacttccggagtctttctgtgcttccgattatcttccgacagaattaaagtttaccggaagaatgagatatacatattgtcctgcatcatcacgaataaagcaaggtgcttttggattcatgagataaatatggatttcttcatcatcaatgacctttagtgcatcaattaaaaattttggattaaaaccaatcataatatcttttcccattttgttaatgtcgatgtcttctttcatcgaaccaatctgagagtcgatctggagttccataccctcatcgttaattgtaataataattggttttttatctccttcttttacaagaagagttgcacggtcaatactatctaaaaattcttttttgttcagtgttacctttgtttcgtaatcactggacaacatctggtcaatcttgaaatattctccctcaattaatctcgaaacaacttttgtattgtcaaattcaaacagaatatgattttcagcaaaatagatatccaccatgtcttctgtctcaccggataaaatcttactgatttcatttaaagtttttcccggaacaaccactttcttgtcagaacattcattctttaacggaatctttcggattgaaatacgatgtccatcaagggatacgactctcaatgtgttgttggcaatctgaaataattcacctgtcatcagtttattgttttcatttactgcgatagaaaagatggtttgacgaattaattcttttaatgtgaactgtgaaatctgaacaccttcatttttttcgataaatggcagataagagaaatcttcacctgactgtcccggaatattaaatttcgctttttcacaagtaatggttgtgttttgtttttcgtctgtcacaattgtaacatcattatcaggtaattttctaacaatttctgaaaagattttcgcatcaagagcaacgattcctttttcttcgatagaaccctctacaattgtctcaattccaagttccatatcatttgatgtaaatttgataatattggcagatgcatcaatcaggatacactgtaagattggcattgtcgtttttgaaggaactgccttcatgacaatgtttacactttttagtaactcagactttgaacagattaatttcataatgtggataacttcctttctgtgaaaatggttttgctataaacatatatatatataatatattaatagtagtagtagtaggggatgtggataatgtggataactcttgaaacccttgtaaataaagggcttaatgggtgttgacaatgtggataactatgtggataacttgtggataactcaaaatcaatgtggataacttttctgcttaaacaacttaaaaagtacttaaaaaaaagttatccacatttttcaccgagttatccacatagttatccacaaaaaaatggcagttatccacattttttttcgagttatccacatttttgacacccaaaatgtggataactatgtcaattttcaagagaagtgtggatgaagattaattttttaattttatttaagcgaatttttagctggattaatcttctttttaagtatattaatcacttctctggtttcttcagaatactgaacttctttttcgattcgtttgattccgttcataatggtactatggtcacgtcccccaagcttgtcaccgatgattttcaaggtgatatcagtcatttgacggcagaggtacatggcaatttggcgcggataagtgatttgagagcttctcttgtttcctattaaatcactggcggataaatcaaagtgttcagcaaccgtacggataatgatttcaggggttacgaccctcatctcttcatccggagaaatgatgtcttttaagactttttcagccagagcgaggttaatttcacagttttccagattggcaaatgccatgatcttattgagagatccctctaattcacggatgtttgaggtaacgttctttgcgatgtactcaatgacatcatcatcaatataatagccgtcaagttcttcttttttcttaagaatcgccattcttgtctcgtagtcaggagctgaaatatcaacgattaagccccattcaaagcgggaacgaaggcggtcttctaagatttccatatctttcggaggtttatcagaagatatgataatctgtttttttgcaccgtgaagtgcattaaaggtgtggaaaaactcttcctgtgtagattcttttcctacaataaattgaatatcgtcaatcatcagaacatcgatgttgcgatatttctcccgaaacttagtcatggtcatatctgcattattaccactgcggatagattcaatcaattcatttgtaaaaatttcacttgtaacgtacaatacccgcgtttctgggtttttctgcagaataaaatgtgcaattgaatgcattagatgtgtttttccaagaccaacgccaccgtagataaacagtggattataagcttctcctggggattcagcaaccgcaacggacgctgcatgtgccattttattgttgcttccgactacgaaagtatcaaatgtatagcggggatttaagtttgcacgctcaacattttcattaataatagttgagggagcttgtactgtttcagatggaatatcttttggctcgattagggcaatttcatattcttctccggttgcctcagaaatggctacttttaagggaagaagataacggttagtaatatagttgataccaatcagcccggtagggactacaattgtcacttcattgtcctcaacactgtggacagtaagcgtttcaagccatgttttgaaagaaatatcagagagctgatgttcctctctgatggtattaagaatatccgtccatttttcttgtattggatgcatggtgtatctcctgtgtttaagtaaatataaaacaacgtaacaatagaaagtgcgaaaaatacactttctatcaaaatactacaagttttgtatttatctattctataataaattgggacttttatcaaccgtttaatcacaaaaatgtggaaaactatgcgaaaaatgtggaaaacttttcccaatgtggataatgtggataacttgcaaaaaagcaatgtggataatgtggataactcgaaaaaaggcattatttgcaaccagtaaatgtggataatgtggataacttctttccacattatccacacgctaaaacccttgattttaaaggattttttaaaaaccaaaaaaagttatccacattttttttgaagttatccacaaaaaaaggtcgagttatccacattttttttgaaatattatgtaaaccaaaaaatgtggataactttgtggataacttttttaaagagtggaaaaattgaaaagttatccacaaaatgtggataacttgcaaaagtgaaaatgtggataactttttcgcaatgcggataaatgtggaaaacttaaaaagcgcaaaataatccataaatgacaaattttaaaagcttcagtcaggcataaattggtataaaaaaatcgaaaaaatgcttgacggagagggggtttatgaatataattgaaatgatgtttactaaataatgcataaccataggaatactatctcaagatagatagatatttatttaaaggaggtgcctggaattatgaaaatgacatttcagccaaaaaagagacagagatctaaagttcacggattcagagctagaatgagcacaaaaggtggaagaaaagttttagctgcaagaagattaaaaggaagaaaaaaattatcagcttaagaccgcagacatgtggtcttttcttctcttttcattaaaaggatggtttatgaaatattcggagtcgttaaagaagaacagagattttcaactggtttataaaagtggaacatcaaaagcaaatcgatatctggttatgtatgtaagagaaaatcagttagaaaaaaacagagttggcatatccgtaagcaaaaaggtgggaaacagtgttgtgagacaccatcttgcgcgccttataagagaaagttaccggttaaatgaggaaaagtttaaatgcggatatgatattgtaattgtagtcagggtaaatggaaagaaccaggggttccattccatagaaagtgcattaatgcatttaggaaaactcacaaaaaccataaaaagcgaagagaatgaaaacgatactaattaaattgattcggttttatcaaaagtatatatccccattaaagagtacacgttgtccctatattcctacgtgttctcaatatggactggaagcaattgaaaaatatggagcagtaaaaggctgcttactggccggttggcgaattttaagatgtaatccattttccaaaggcggatatgacccggtgccctgatgaaccgaaaaatgatgtggataagaacacacactaattagagaaatattggggtcaccggttatataaggaggacgaattttgggtgcattgttaagtaagagttcaatgccgattgtaaaatgggtagccgaggtaatgggctggctgatgaacggcatttacaagattgggattcataatctcggtctttgtattatattatttacaattatcatttatgcattcatgatacctctgcagattaaacagcagaagttttcaaaaatgaatgcagttatgtcaccagaattgcagaaaatcagtaaaaaatacagaggaaaaaaagaccaggcttctcagatgaagatgcaggaagagacaatggcagtttatgaaaaatatggtgtgtctccaacaggaagttgtctgcagttattcattcagatgccgattttctttgctttataccaggttattattaatattcctggatatattggcgagattaaagcaatttttgacaaagccgttgtaagtatcacaagtgtagacggatacgcagatgtcctgacacagtttatcaaggatgagggattaagaacttatacttggagagcagatgatgtaacaacaaaccgtattattgatgtattatataacttatcaccaacacagtggaaacacttaggtgaaatcagtgattttagtggattctcagatgtattaagcaatacagcaaatacaattcgtccgatgcagaatttccttggactgaatatcgcagataccccgcttgcactgattaagtcaggatggagttcacactcttatctgttgattcttgcagcagttttaattccggtattatcctggctgacacagatgttaaacattaaattaatgccaacggcggcaaccactcaggacggtggagcaaatgaccagatgaacgcaacaatgaagagtatgaacacatttatgcctctgttttctgcatttatctgtttctcattcccggttggtattggtatttactggattgccggttctgtgattcgttgtatccagcagcttattattaataaacacctggacaacatggatttagaagactatatccgtaaaaatcaggcaaaagctgctaaaaaacgtgaaaaatcaggacttccgccacagaaaatcacacagcaggcaaaacagaatgtcagaaatattgaagaaccaaaatgtaccacaaatttaaagaaatacaataataacagtggttcaaaagctgtagatacttacagagaagtaccggaaacaaaaccgggaagccttgcatcaaaggctaacatggttgcagaatttgataaaaagaataagacaaagaaaaaataacggtaagggggaagcgttatggaattcaaagagttttctgctaaaacagcagatgaggcaattatcaaagccagcattgaacttggcgtttccagtgaaaatctggagattcaggttgtgactgaaggcagttcaggattttttggaatcggtaaaaaaccggcaatcataaaagctcgcagaaaagaagaaaccttaccggaagaacctgtagcagaagaaataaaagagtctgttccggtaaaaaaagaagtgaaaaaaactgataaggcagcagaaaaacctgtagaagaaaccgtaaaaccggtgagacatcaggaaacaaaaaaagagcagccaaagcctcgtgaagagaagaaaatcatcaaacgaagcgaggaagagattgcagaaatcaaagcggaagctgagatgttcttaagtggtgtatttaaagcaatggagcttgaagttgagcttaaaatagaatacacagcagaagacggcagccttgaagttgaatttatcggacaggatatgggtattctgattggaaaaagaggacagacactggattctcttcagtaccttacaagccttgttgtaaacaaaggcagacagggttatgtccgtgtaaaacttgatacagaagactatagaaacagaagaaaagaaacacttgaaaatcttgcaaagagcattgcttacaaagtaagaaagacgagaaaacctgtttctttagagccgatgaatccttatgaaagaagaattattcattctgcacttcaggggaaccgttatgttgaaacatatagcgagggcagtgaaccatatcgccatgtggttgtaaaattaaagaaataatgtaataaaaaataaagacgttctaggtgaaagcgtgaatgttggagatggattctctgtgcttttatctggagcgttttttgtttcttaagagtaaattaaaaagtatattaaattgggttaggaggctggattatgccgatactggcatcagaaacgatagcagcagttgcaacagctatgaccgcttcaggaattggaattatacgaatgagtggtccaaaaagccgtgaaattgcaggaaaaatctaccgttccaaaaatggaaaaaataagatagaagaagtaaaatctcacacgataaattatggttttatttatgatggagacgaagaaattgacgaagttttagtcatggtaatggacggtccgagaagttatacaggggaagataccattgaaattgactgtcatggcggtgtgcttgcaatgaaaaaagtgctggaaacagtcattaagtatggtgcaagaccggcagagccaggcgaatttaccaagcgtgctttcttaaacggaagaattgatttatcacaggcagaggcagtcattgatataattaatgcaaagaatgagtatgcattaaagagttctcttcatcagttaaaaggctctgtgcagaaagtaatctgtgaaatcagagagaatattatctatcatattgcatatatcgaatctgctttagatgacccggaacatatcagtgtggatggttatggggaaactttggggaaagatatcaaaattcagaaagagaaagtggaaaaccttctttctacagtaaaagaaggaaagatgatgaaagagggcattaaaacagttatcgtagggaaaccaaatgccggaaaatcgtctcttatgaatgtacttgtaggagaagaacgtgcgattgtaacggatattgcaggtacgacaagagatattttagaagaaacgattgtgcttcatggaatttctcttcgtatgattgatactgccggaatccgtgatacagaagataaagtagaacaaatcggtgtaggacgggcaaaagagtatgcaaaagatgcggatttgattctttatgtggtggattcttcacgtcctcttgatgaaaatgatgaagaaatcatggagattctcgaagataaaaaggcaattgtgctgttgaataagaccgatttggaacagaaagtaaccgaagaaatgttaaaagaaaagctttctcatccagttgtgtcgatttcagcaaaggaagaacagggaattgatgtgctggaacaggagattaaaaacatgttttttgaaggtgaattaagctttaatgatgaagtttatatcacaaatatgagacataaaacggctcttgaagaagcacttgacagtttaaaaatggttgaaaacagcattgaaatgcagatgccggaagacttcttttcgattgatttaatgaacgcttatgagtctttaggaagtattatcggagaggctgtaggggaagatttggtcaatgaaatcttctcaaaattctgtaccggaaagtaaaaaatcaggataaatatagaagcgaaaaaggagaaaaacagatgaatcatttgacagaaaattatgatattgctgttgttggtgcaggtcatgccggatgtgaagcagcacttgcgtgtgcacgtctggggttggaaacgattatgtttacggtaagtgtggacagtattgcactcatgccctgtaacccaaatgtcggtggtagttccaagggacatctggtacgtgaattggatgctctgggtggagaaatgggaaaaaatattgataaaacattcatccagtctaagatgttaaatgtatcaaaaggtcctgctgttcattctttgcgtgcgcaggcagataaacaggaatacagcagaagtatgcgccatacactggaaaatacagaacatctgactattcgtcaggcagaggtaacagagattcttgctgaggacaaacagattaaaggagtaagaacctattctggtgcagagtatgcagtaaaagcggttgtgctttgtacaggaacttacttaaaggcaagatgtatttacggtgatgtaagcaatcataccggtccaaacggacttcaggcagcgaatcatctgaccgattccctgaaaaaacttggcatcgagatgtatcgttttaagacaggaacacctgccagaattgacaaaagaagtattgacttttcaaagatggaagaacagtttggagatgaaagagttgtaccgttttctttctctaccaatcctgaagatgttcagattgaccaggcatcctgctggctgacttataccaatgaaaccacacatgagattatcagaaataatttggaccgctctccattatattccggtatgatagaaggaacaggtcccagatactgtccatccattgaggataaagttgtacgttttgcggacaaaaaacgccatcaggtttttattgagccggaaggattatatacaaatgagatgtatgtaggcggaatgtcaagctctcttccggaggatgtacagtacgaaatgtaccattctgttgcaggattagagcacgcaaaaattgtaagaaatgcctatgcgattgagtatgactgtattaatgcaagacagttatatccgacacttgaatttaaagaaatcaaaggtttgttctcaggcggacagtttaacggaagttcaggatatgaagaagcagctgctcagggattgattgcaggtatcaatgcagcaatgaaagtgcttggaaaagagatgctgattttagatcgttccgagtcttatattggtgtattaatcgacgatttggttacaaaagagaatcatgaaccataccgaatgatgacaagccgtgcggaatacagactgcttttaagacaggataatgcagacttaagattaagaaaaaaaggttatcaggtgggtcttgtaagcaaagaacagtatgattatgttttgtggaaagaagcaaaaatcgaggaagaaaaagagcgtgtggaacatacttatgtaggagcaacgaaagaggtacaggaactgcttgaacagtacgaaagcacacctcttaaaaatggatgttcccttgcagaattaatccgccgtccggaattaaactatgaattattagctcctttagataagaaaagaccggaacttccggaagatgtaagagaacaggttaacattaatatcaaatacgatggatacattaagcgccagatgaaacaggtggaacagtttaagaagctggaaacaaagaaacttccggaggaactggactatgaagcaatcagcggacttagaattgaagcaagacagaaattagaagaataccgtccggtttctgtaggtcaggcttccagaattgcaggggtttctccggcagatatttctgtccttcttgtgtacctggaatcttatcgaagagggggaaatgggaatacatgaattatgatttaacgctgttagaaaacgctgtaaaagagtttaaaattacactttcagaagaacaaaaagcgcagtttattcagtattatgagctgttaattgagtggaataaggtgatgaatctgaccggaattacagagtttgatgaggtacttcagaagcattttgcagacagtctttcggttgtaagagcactggatatgagcaaaattgagagctgtattgatgtcggaacaggggcaggatttcctggaattccattaaaaattgcgtttcctcatctgaaagtaactctgctggattccttaaataaacgtttgaaattcttaaatgaagtcatcgaaaaattaggtttagaaggcattgaaacagtacatggacgtgcggaagatggtgcaaaaaaaccagagcttcgagaggcttttgatttaagtgtgacacgtgcagttgcaagggtaagtgtaatcagcgagtattgtctgccttatgtaaagacaggtggatactttgctgcatataagtcgggaaaagcggcagaagaactggaagaaggcaaaaaagcgattgcagttttaggcggaaaagtcgaaaaaacagaagaatttttgttgccggactcagatatggaacgtacgattttgctgataaaaaaagtaaaaaatacaccgaaaaagtatccgagaaaagcaggaactcctgcaaaagaaccgattgtataagtggaaaattggataaaaaattgtatgaaaataaagaacgaaagagagctgaaaaaggctctcttttttttattagggatatttgcaaggattcacagaaaaaacacattctcatctaatttttatcacaaatagtaaatagaatagaacggtgagaaaaatataaaaaagcaagtacaatattaaaggagggaataccttgattgaagtaaaggatctggtcaaaaaatatggtgaccatgtggccgtagaccatttgagttttaccatagaaaaaggaaaaatttatggatttttaggaccaaatggagcaggtaaatcgactacaatgaatatgattaccggctacattgcctcgacacagggagaaattctgattgatggacacaacattttagaagagccggaagccgcaaaaaaatgtatcggttatttgccggagctacctccggtttatcaggacatgacagtcagagagtatttaaaatttgtagctgagttaaaatccattccaaaagcagagcgggaaaagaatataaaagaagttatgtcaactacaaagcttgaggaagtacaggaacgtctgattaagaacctttcaaaaggttttaaacagagggttggaattgcacaggctctgcttggatatccggaaattattattttagatgagccgaccgttggtcttgacccgaaacagattattgaaatcagggatttaattaagagccttggagaaaaacataccgttattttaagttcacacatcctttcggaggtaagtgcggtctgtgaccatgtattgattattgaccgtggaaaactggtggcaagcgacacaccggagaatttaagtaaagtaatggaaggcgcaaattctcttgaacttacagtaaaagggaaagaagaagaaatcagagaggcaatgaacctcgtagaaaatattcaggaaatgatttaccatgaatcttttgtgccggatgcctgtgattttaccgttaaaatatcaggggaacaggatatgagagaaaacattttctttgctctggcagatgcaaaatgtccgattttaaaaatgcagccgacaaatatgacgctggaagaagtattcttgaaattgaccgaagacgacaatgaggaggagaaagaaaatgctggcgatttataaaaaagaattaaaaagttatcttacatccatgcaaggatatgtgtttatggcatttatcatgctggttctggggatttattttacggcatataacttaaattatgcaagtccggactttggaacaaccttaaattccgtgacgtttgtatttttgattatcactccgattttaacaatgagaattttagcggaagaaaaaagaaataaaacagaccagttattattcacttcaccggtgccaatctggaagatagtatttggaaaatatcttggaatggtgacaatttatctgattccagttgtgattacgttgttttatccgcttattttggcaaaatacggaacagtttcttatcctatgaccttaactgcaattgttggatttttctttttgggatgtgccaatattgcagttggactttttttatcttcgattacggaaagtcaggttatcgcagcggttcttacctttgtggtattattctgcagttttgtcatgaatggaattgaatctttcttttcacagacggcgatggcttccatgcttgcatttgcggtacttgcagtcttaattgcaatggtcgtctatcagatgacaaaagataatattttgaccggaattacaggagtggtactgcttggagcagttgtaattatatatattgtaaaatcctctttgtacgagggagcaattcaaaaattgttagatttgctcgcaatcgcaaatcattttgataattttgtaggaggaattttggatttctccggaattgtatatatgttatccgtaatctgcattttcatatttttaaccgttcagtcaatacagaaacggcgttggagctgatgatttgaggtgaatagagaggagaaaatgcaaatatgaagacaaacaatgaaaataaagagttaaacaaagactcaaataaagatttaaataaagacttaaataaagggtcaaatgaagatttaaataaagagtcaaataaagacgtaactaaaaaaacgaataaagagtcaaacggcaaaaaattcaaaaaaatagatttcaaagaattacgaaagaaaagcaaggaaaaacgaatccaaaataaaaagaacttaaagcatggttcctacagcatgggtgcaattacaatttttattgcgattatcgtagtattaaatctggtattgcaggaagtgccgtcaaaatacagagaaatcgatttaagtacgcagaaactttacagcattggtgaccagacaaagaaagtacttaaaaagctcgataaagacgtagagatttattatattgcgcagagtggttcagaaagcagtgatatccagaaacttctggaaaaatacgaagagggcagtgaccacatcaaagtggaacagaaagaccctgcagtaaatccgaaatttgtttcacagtatacatcggatggcgtgagcaataacagcgtaattgttgtgtgcggagataaaaataaagtcattgataacaactcattatatgaaacgactgttaattatcagacttacagtaacgaggtaaccggatttgatggagaaggccagattacaagtgcaattaattatgtaacatccgatagtatgccggtgatgtatacgttagagggacacgatgaagcaaccatgagtgataccttaaaagataccattcagaaagcaaatatcgatattcagtctttaaatctgctgacaatggacagtgttccggacgatgcagacatcttgtttatctttgcaccggcaaaagatatttcagaagatgaggcgtctaagattatttcttatctggaaaatggcggaaaagcgttgatagtttctaattattcttctgaagaaatgccaaattttgcttctgtattagagaattatggtgtgaagacggcaggtggaattgtacttgagggagataccaatcattatatttctcagaatccatcctatctgcttccaaatatcgaaagtaatgacattacttcaagcctgtcatctggcagtcgatatattttaatgcctctggcacagggaattgtaaagagtgataactacagagattctcttgaaatcactgatattctgacgacttcagacggttcttactcaaaagtaaatgtagaagatatgcagacaatggaaaaagaaagcgatgacattgacggaccatttgcagttggtgtttccatcacagagaatttagatgatgagaaagaaacacagattgtttattattcatccgaagcgctgtttaatgaccagatgaacacaatggtatccggagcaaactatgaattgatttctgcttctgtaaactggatgtgtgagagcgaagaggatagtaatacaatttctattgcaagtaagagctatgatacttcaacacttacaattccggcagcagatgcaagtttctggagtatctttgtaacagcagttgtaccggtagtgattctggtaattggcggtggtatctggatgaagaggagaaaacagtaatgaagaaaaaaaatatcggattaatcgcaggaattgtactgcttgttgtgctctgcgtagtctattttgttcttcataatcataatgccagcagcagtgaagcagatagtacagatacagcagcaacagcgtttgagacagatacagacaaattgacagagctgactgtgacaacggaaggtcagtcttatacttttacaaaatcagatgataaatggagttatagtgcagatgcttcatttccactagaccagagtaattttgaagagctggcaggaaagttaaaatcaatcagttcagacagggagctcaaagatgtagaggctgtatcagagtatggacttgatgtacctgctgtacaggtttctattaaaaattcggatgatgaaacccatacattagagtttggtgcagtaaatgacatgacaagcaattgttatatgacaattgacaaggataccagtaaaatctatatggttgcttctgatcttgaaaccgcttttaattttaatttaagtgaccttgcagaaaaggaaagtttcccgtctattacagctactacagttacgaaactgactgtagaaaaacagggcgaagaagccgaagtgattgaaaagagtgattctgcttccaccggatggagttatacaaaaggaagcacacaaagagatattgacagttctaatacttccaatctcttaaatggaatttccagtctttcctggggcagttttgtaagtgcagataccagtaagcttgcagagtatggattggatgcaccgaccaagattatgattgattatcaggtgacagagacaaaagacagtgacacgagtaccagtgaagatgatacgagtgaagacagcagcagtaatgaagatgcagaaaatgactctgacagcgacagtaccacagaaactgtgacaacgaataagcaggaagttttgcttcttggaggtcaggacagcagtgggaattattatgcgaagcttgaaagccagtccaacatttataccatttcatcttcgagtgtggaaagtttcttaaatatcgacgtgaaaactctggtcagcaattatgtctctaattatatctttgcagacctcgaccgtgtaacaattcaaaaagatggagaatcttatgaatttacaaaaacaacggaagagaaagcaaaagaaaaagatgacagtgatgattcaaagtctgaagatagtgatacagaatcggatacagaaactgtgacaacctattttatgaatggaaacgaaataaaattggaagatttctcaagcttctatagtaatatcagttctctggaatgtcaggagtggcttgatgaagtaccggaaacacaggatgagccggaaatgactgtagaattttataaagaaaatggagtttacttcaaagtagaatattatccgtatgattctaacttctatcttgtaaaaaataatcagggaactgcgtgtctggtcaataaaatgaagataaaagaaattgaaagttcttttgaaaaatttttggaaaaacagaattaatgagtagaaattaaaaagcgagaggaatgtttcacgtgaaacattcctctcgctttttagtcatcaagaaaaacagacagacaatcaaataactgttctggtgattctaactgaggaagatgttttgcttcttttaaaatgtaagtctcaattgccggatttaattctacatattgagagagaacttcgcacttagtgagttcgccttccccttcgataataaagatgctgttgtttatattttttaatgcatgtacgatattgttgttagtatatcctccaagtaaactggagaataagaaacgaccgcttcccatgcctttgtgggctgcttcatagtaagtgtcgagccattccgctttgatatggaatggattgtaaagataatcttctgtaaatgcaagttgaacattactctggcagaccatcatgttataaacaagagttccgaacacaggaagctcaagaaaagatttataaagcttgctgcgtttggttggaatcttatttaactgtgaaagtgccggcggattaatcattaaaatttttctaaacagttcgttttcgttatgacaggcgaggattgtaaaagagccggaaaaaccactggtaatcacatcggttctttcgtgaattacgtttttgataaaatcagatattgcctggacatataaatagttggtgtaagtaatatgctgtttatcagaacggccgcatccaggtaagtcgatgcagtagacggtatgatttttctcaagctgttttacaagtgcttcccattcataagcggaactgtaaatggttaaatcgtgaattaataaaacgggagaacccgtaccttgttttgtgtaataaatttttccaaaacgccaattgtaataattgcttgccgttgactttaacaagtctttcattattgcggttgtagaaatcagatggttcatgaaatgaataatagcagttgcggtggtaaataatataccggttgtaataagtttgtatctatgctttttcataaaaaaacctcccaatataggattactttagttagttataattataagccattaactcttattatacaagctgaaagtagggagaagaatagtgtgataataaaaaaaatgggaaatgtttcacgtgaaacatttcccatttttttattgattgattaatgaaatttatatcgtaaaaaaatataatgtttcacgtgaaacatttgtgtagaaatacgtttaagaagatgttataataaccattgaatgaaataaatacgaagtttgatgaaaagaggaaacttaagtgggaagaataatagcaatagcaaatcagaaaggcggagtaggaaaatctacaactgcaatcaatctgtctgcatgtcttgccgagctgggacagagagtccttcttattgatattgacccacaggggaacacaacaagcggagtcggcgtagacaaagataatgttaatgcgactttgtatgaacttctggtgggagagtgcgaaatttcggactgtctgattgagaatgtattcgaaaatttatccttgattccgtcgaatgtgaatttgtctggtgcagagattgaactggtaggcgtagaggggcgtgaatttcttttgaaaaatcatattgattccattcgtgataattatgattttattattatggactgcccgccgtctttaaatgtgttgactatcaatgcaatgacaacagcagattctgtactggttccgattcagtgtgagtattatgcactcgaaggattgacacagcttattcacacgattgaactggttcagaaccgtttaaatccggatttggatattgaaggcgttgtatttacgatgtatgatgcaagaacaaatctgtcattgcaggttgttgaaaatgtaaagaacaatctggaccagtctatttacaagaccattattccgagaaatgttcgtcttgcggaagcaccgagttatgggctgccaattaccttatatgataaaagatcagtaggggcggaaagctacagactccttgcagaggaagtattacacagggaggatgaagaatggcggtaaaaagaggtggacttggcaaaggtcttgattctatgattccggttttagattctacagcgacaaaaaagaaaaccggaagaacagcaatcgataaagaagcgctgcagaatgcggcaaaagaagctcataaacatcaaaaagaaaagatggaatttgaggggaaacctggagaacaggtacagattgtgaagctgacaaaggttgagccgagcagggaacagccgagaaaacagtttgatgccgatgcacttcaggaactggcagaatctattaagcagtttggtgtacttcagccattattggtccagaagaaggaagactattatgagattattgccggggagcgcagatggagagcttctaaactggcaggactcaaggaggttcctgtaattgtaaaagaatttacagaacaggaagccgttgaaatttctctgattgaaaatattcagcgggaagatttaaatccgattgaagaagcaatggcatataaacgtttgatggaagagtttcatttaaaacaggatgcgattgcagaacgggtttcaaagagcagaactgcagttacaaactcaatgcgtcttttaaaattagatgacagagttcagcagatgctgattgatgaaatgatttcaaccggacatgcaagagctttgcttgcactggaaagtaaggatgcacaggcggaagcggcagttaaagtattcgatgaaaaattgagcgtacgagaaacagagcgtttagtgaaagaactgttaaatccagtgcagaaaaaagaagagaaacccaaaaatcaggcagaagaactggtttataagaatctggaagagaaaattaaacagattatcggttcaaaggttgcaattaaccgaaggacagataataagggaaagattgaaattgaatactattctcaagaagaattggaacgtattgttgaattattggaaacaataggataagagagaaaacgaggagttagagcagatgggtaatctaatcagcaagattcagtctatttccggtgtgctgtcaatttttttactgattgtggtaattgcacttttggtatgtgtggtcagtctttttttggaagtaaaccgactgaatcaaaaataccgcgtatttatgaaaggaagagatggacagtctcttgaaaaatcgttccgacgcaaatttgcaatgattgacaaagggctggatgcggcagcggcaaatgagcaggaaattgaaaaattaaaagaaatcatgggaaacaccttgaacaaatatgctattgtgaagtatgatgcatttgaggatatgggaggaaaactcagctttgttctggctatgttggacgataagaatacaggatttcttctgaatgcgattcacagcagagaaaactgtttcctctatattaaagagattgtaaatggggaatcctatgtaatattaagccaggaagaagtgcaggcattaaaacaggccgtaaatttcagacaaaactaaaaaaaagaagcagggagaaagattatgttagacattaaatttttaagagaaaatccagatgtagtaaaacagaatattaaaaataaatttcaggacagcaaattacctctggtagacgaagtaatcgaattggataagagaaaccgtgaaatcaaaggagaagtagaagcgttaagagcagaaaaaaataaaatctccaaaatgattggtactcttatgaaagagggcaaaagagaagaagcagaagaagtaaagaaacaggtaactgcaaatgcagagactgtagaccgtttatctgctgaagaaaaagaagtagaagaaaaaatcaaaaaaatcatgatgacaattccaaatatcattgatccatctgttccgattggaaaagatgacagcgaaaatgtggaagtacagagatatggtgaaccggttgttccggactttgaaattccatatcatgcagaaattatggaaaaattcaatggtcttgatttagacagtgcaagaaaagtagccggaaacggtttttactatctgatgggagatattgcacgtcttcattccgcagttatttcttatgcaagagatttcatgattaatagaggatttacttactgtgtaccgcctttcatgattcgaagtgacgttgttacaggtgttatgagctttgcggaaatggatgcgatgatgtacaaaatcgaaggcgaagatttatatctcatcggtacaagtgaacattccatgattggtaaatttattgacacaatcattccggaagaagagctgccaaaaacactgaccagttattctccatgtttcagaaaagaaaaaggtgcacacggacttgaagaaagaggtgtataccgtattcatcagtttgaaaagcaggaaatgattgttgtctgcaaaccggaagaaagcaaaatgtggttcgataaattatggcagaatacagttgatttattccgttctatggatattccggttcgtacactggaatgctgctctggtgatctggctgatttaaaagtaaaatctgtagacgtagaagcatggtctccaagacagaagaaatattttgaagtaggaagttgttcaaacctcggtgatgcacaggcaagaagactgaaaatccgtgtgaatggaaatgacggtaaatacctggcacatacactgaataatacagttgttgctccgcctagaatgttaattgcatttctggaaaacaatctgcaggcagatggttcagtaagaattccggaagcactgcagccatacatgggtggaatgactgagataagataaggaggcagtctttgcacagttatttaaggtccattggtttttcagaactggaaagaaaagaacttgaccagattttgaaagaggtaattacacaatacgatgaaaagacagtaatagaaaactctgagggacatctgtttgtggaagtatcaaaaatatttggatgtgacgttggaatcacagtctgcggagaatacgatgaaaataatgaatttgagatggaatattattttccgttcttccgcggaactggaattacgacacaggaaaatgtgttaattgaacgccatgtgggaaaagagtcctatgccggagcagtggatgatataagaatcggcgttacaattatcttttatctgcaaaatgcagccgaatatctgacagaacaccggcatggacattatacaaagggtgtgtatccggtgactcttgccggacttgcaagagaagccagaattcttcttcctgttaagaaagatgaaaaacagcaaagagaagaacgggagaataccgtgaatcgtaatcgaatgattgcagcagcccgtaatggtgatgaagaagcaatggaaaatctgacgatggaggatattgatacatattccatgatatctggccgtatagcaaacgaagatatttattcgatagtggatacttattttatgccttatggaatggaatgtgatttgtataatatcatgggagaaatcacagaatggtccattacaaaaaatacactgacaaatgaagaaatctatcagattcgcattttctgcaatgatatggaaatggatatctgcgttaatgcaaaagatcttttagggaagccggaagttggacgaagatttaaaggagttatatggcttcagggaaatgtggatttttagatgaaacctgagaattaaaagaaagaatcttgcttgcgagattctttcttttgtttcacgtgaaacatattatcggttgagggtagggttaaattatggtagaatgataccacatgatacaagacagtgtcataaaaactcacaaattcaccaaagataaagtgatattgtgaaataaaaaagaagggaaaaggaaaaaatggagttatttgtcaaagtgatgaatgtagtcaatgatatcgtatggcatcctgtaatgtgcgtgtttcttatgtttgcggcgttgtggttcacgtttcatttaagaggcatgcaggtacgaagatttggcgatatgcttaaatgtctgactgaaaagggcgacaataaacaagatactggtctttcttcttttcaggcatttgcaacaacagttggaggtcgtgtaggaaccggaaatattgcaggaacggcaactgcaatttttatggggggacctggtgcaattttctggatgtgggttactgcaattttaggtgcatccacaggaatggttgagtgtatcttaggtcaggcatataaaacgagaaatctgggagaattaaccggaggacctgctttctatatgtcaaacggaattaagaataaaaaattaggaaagatactggcctttttattctgtatcgcagtctttatcggacctggattcttgcttccggcaatgcagactcagacagcggcaacagcggtaaatgtagcatttggacttccatttgttgttgttggagtgattatgacagcaattgttgcatttgttattatgggaggaattaaacgtatcggacaggttgcggaatttttagcgccggttatgtgtggaatttatttcctgattacgattattattattgtacttaatattggaaaagttcctggaatgtttggttctatctttgcaagtgcatttggaaaagatgcggtctttggcggaatcgttggttcggcagtttcctggggaatcaaacgtggattcttctcaaatgatgctggtaacggaatgagccctttgatttcagcaacaactgatacttctcatccggtaaaacaaggtttggttcagggattatctgtgtatatcgatactcttttggtatgtacttgtaccggaatttctattttgcttgcgggaacttacaacgttgcagcagacggagcaggtgcttctctgttagtagagcatgttccgggaatacagtatggaattgcatttatgcaggaggcaatgtcggtatcaatcggtaaagcaggagcaatgttccttgcaattatgctgtttatctttatttttacaaccatgctgtcctattcttatcagttggaatccacatgtaaatatctgttcggcgagaataaaatggtggttacaattgtgcgtattttattcctggtattctgcatgtttggtattttgattgatggtgatactatctggccaatgggtgatattggtgttggatgtatgctttgggttaatacttttagtatcttactcttaactcccaaggttttgaaaatcgtaaaagattatgagaaacagaaaaatgttggcttgaacccattgtttgaccctgctacagtaggaattgaagataaagcgggggtatgggatacttatgtaaaacagaaaaaagagcgtggagattatgaaaatccgcagcttggatatgataaaaaataagaaacttttgtagagatatactcttgtaaggttttggctataccttcagaaaagatttcgagagtatattaagattacatggaggtgtgcagacgtggaatttgattttaaaaacgaatttgaatctatgatgaaatcgaatgaactggacacggttgttgttttgggacacatcaatccggatggagatgcagccggttctgtgatgggaatcgcacattatattggcgtgaattatccggagtatcaggtattcccttatctggcggatacgatagacaaaggaccaaaacttcaggtgcgccaggataaaaaatttgatccgtttgaaaagccggatttgcagggaaaacgtttcgcaacagtgatatgtgatactgcgacattggcacgtttaagcggaagagaattttatgaagcatctgtcgcttctattgtaatcgaccatcatgcctcaaatgagggctatggagacagaaactatacaaaggtttcggaagcctgcgcggtaaatgtattttatagtttgaatcaggatgatttaaaaaaagcggcagaggcagaagaatatccaaacgctgcagattatatctatcttggaattgtacatgatacgaatgcttttcaaagagcagatgaaagtatcatgaaggctgcgacaaagcttttagaacttggcgtagaccatagacgaattatacagactcggcagattgatacgttagaagatttggaaaaacgtgcagacattttaaaaaatgcgatacgtgtgctggatggaaaagtcgcctacgtgtgtataaacaaagaagaaaaggttaaaaagaatatcagctatgaggaaattcatccaatcagcagtattctgcgtgactgtgcagacattgaactgggatttacaatgtatgaagaagaaccggacaggtggcgttgttctttccgctccgatggaaagtggcttgatgtaaatgaattgattacaccatttggtggaggcggtcatgccggggcagcagggcttagaaaacgaaccggtgatatggaagaacttagaagtcagattcttgagagagtaaaaaaactaagagcagaaaaatgtttcacgtgaaacaaagcggttgtcagtttagttaatgacagccgctttttgttacttgtacggtgtactggtttaaatgtttttaatatagaagcaaggtttgcagaaaccagatgttgcttaatgactgcgttcatgagtaagtagcgaagcggattgcgaatgtccgctttacgagaatcaaccggtgaattataaaatgagttttcattaaatcagtggattgtgaatatttgtttgataaaaacaagatattgttaaaaaaatgtttattaaactagatatagtattttctgattttgtatgttatactgacactagattacagaaaatcagaaaaaacgtgaaaattgcccgtcacaattacgacagtaatagcatttccagatattctatgataatgagtggggatatacatctcagattttcagactcattcagtatatgaatcagattgatactggtcgataacatttaagatgtgacagggcagttaaattctgattttaacgtaacctgctttctgtaagggacatatccattcgttattacgattatgaaccgtaaatgaaaatcggaagccgggagataagtctggcttccgattttttgtatttagatgctctggtaacttagttaccgaggagtttacatagttgtttcgtatgtttgttttctggtaacccagaaaaagacgcatacaaagataattcctttgataatcgatgtggaagaaaatgcccaccagattccgtgcagtccaagggaagtattttttaagaaaatagcaagagggatccttgaacctgtaaatataatactgatgatactgcaaaggcgggtcattccaagtccggaaagagcaccgattgtggtcagttcaatacacataaagccttcactgaatccgatgataataagatatccgactgcgatggtaatcgcttttggttcatgaaagaagattgttgcaattgtatttggcgcaaagacaaatacaagagtgataatcagcccccagatgccaacggtccataaagaagcatgatatcctttgcggacacggttcatttttccggcaccatagttttgagcagtaaaggcatttaaggctgatgcaaaaccatctgcagtattccaggatacggactcaatctgacctccgactcgttgtgtggcaaccgcttctgcaccgaaagcagataccatacgggtaagcaccatcgagataatacaatatgccataccctgaatggcggtaggaattccaatccggcagataccatttaagtaaggtgccggaatttttgtaagtaaatgagttccctttaatacattttcttttttctgcttgataacgcagattatcataatgctcataacgataaactgtgcagttacggttgcaattgctgcaccggtaacgccaagctttggaaatggaccgggaccaagaattaaaacagggtctaaaatcatgtttgtcacaagtccgatgagattggcgagaaatggtgtttttgaatctccttgcgcagtataaattccggttaacgtgactgttaaaaaagaaaatacaatcagtccgcaggcaattttcgtataggacaatgcggctgagactgcttctgggtcattgagcttaaaaaatccgaccatctgccggacaaaaatgaggcataaaatagcgtaagccagtcccataaaagtagatagctgcacagcggtctgcgcaaaaccgtgtgctttttctttttctccccgtcctaaagactgtgcgacttttacctgaccacccatccttgccatggaagccagtccctgcgaaagccaggtaaacataccaccaactccgactccggcaacggcttttgaaccaagcagaccaatccatgccatatcggtgatattgtataatgtccccagaaatgaagaagccatgatggggagtgcgagtttggttaaggtctttagaataggaccttttgttaaatttccatccaacgtatttgtgtaacctccaaattattctgtatatctatgttatcttattttatgaagaaaagcaacgagaaaaaagaaagaaaatttgaaggattcattgagaaaatctggatatcatgatattctgtagtcagaaaatgtcaaaaaggagagaactatatgaagaaaaaatcgtttttgctatcatttttccttgccatgctttttgttgtattaggcagtgtgaatgtaaaagcagatgaaacattggaaggatacacttatgtcaatccaatgtatgaagaccttgaggggaattttgagtttgagtctgattttgagctgtattctgagtctgatagtgaggaatcagatgaagaggatggaattgacacttatgattcgaggagtgttcagtatacgagtgacaagcagagtctgataaagacattcagacagcagttagtcaatcgtgcagaaacaattgctttgtattatcactgtaatcagaagattacacaggatttttttgacgagttctctgctgaactgtttaatggggcagtggcacatacgggtgtaggaaaagagggagattatatcagatggcactaccagggatggcgtgtcaatgcaaattataaaacggaccgcaatggtggatacaatttgaatattacttataatatgtattatttatcagacgcatcacaggaaagtcagatggatcaggcggtttccaatgtgttgaagtctttaaatctttcaaataaaacagattatcagaaaatcaaagcgatttatgattatatatgttccaatatcacgtatgattatgtaaatttaaatgatgattcctatctcttgaagcacaccgcatatgctgcattgattaataaaacggcggtttgtcagggatatgcaacattattttatcgtctgtctttggagtcgggggtagatacgagagtcattaccggagattccggaggtccacatgcatggaacattgtgaagctgaatggaaaatattataatcttgacagtacatgggatgctggttcatcaagctactattatttcttaaagagcatgaatgatttttctaaccatacgagatatgaagaatatcagacatccgattttacgtccgcttatccgatggcagagaaatcttattctgaatcaggaaatcaagagccacttgaaaaagaacataattatggacagccaatgtatgtatgggcgaatgaccacaaatcgattaccgcagcgcgtatctgccagaatgattcaagccatattgagcaggaaacagcagaagcagaacaaacggttataaaagaaccgacctgcacagaaaaaggcagtgttctttggcgtgcggtgtttgaaaatccggcatttgaagcacaggaagaagtggttgaagaacctgcgcttggtcatagctttaaaaatggagtctgcgtcagatgtaatgcgaaaatcacaggacgctggatgaaatcaggttctaaatggtggtatcgctatgaggatggttcttatcctgagaatggattatataaaatcggcaatacatggtatggatttgatgcttccggctggatgaaaacaggatgggctgcttttgataaaaactggtattattttgcaccgagcggagcgatgaaaacaggctggctagcagaaaataaaatctggtattacttgaaatccgatggaaagatggcaaaaggctggcttagagtagacggtgcctggtattatatgaatggaagcggacatatgctgaaaggtttcattacggtaggaaacggaaaatactatatgaatggaagcggaagaatggtaaccggctggaatgtaataaatggttactggtactactttacctcaagtggaaagatggcgaccggctggcagaaaattgataataaatggtattatttaagttcagacggtaaaatggcaaaaaacacctgggtcggaaactggtatgtaaatggctcaggcgtgtgggtaaagagcaggtaaaacaatataaaacaatataaagaagtataaaaaagaaaaaaagaaatcctcggttgctgctgacagccgaggattttctcttatatgattagcctaagaagaagttcattggaacagtaacaatagcagggaaaagtaccatcaataataaaatgatgacttcggctaataagaaaggccaaatggattttaccatgcgttccatgttaattttacctgcaccacatgcaacatttaatacagttccgacaggaggtgttaacagtcccattacagtcattaaaataaatacaactccaaagtatgcaacatcaattccggcagcttttacagccggcagtaaaacaggtgttaaaatcataatcgtaggagttacatccatagaagttccgactaataaaacgattatacagataataaacattaacagtatcggatgattgataaatggtgcaagaataccggttacaatagccggaacatttgcaacagtcatcatccaggatgaaaccatagctgctgcggctaagaacatgataacagaagaagattttgcggcggaaacgaggcagtccattaacatgttaatttttaattctttgtatacaaataatccgattacaagtgcatatactgctgcgattacaccagcttcggttggagtgaattttccacttcttaatccgacaagaataaatgcaggaaggattaatgcccacaagccatcaattaaggctttcaccacttctttggcagactgtctttcagcttttgcgaggttatcttttttggcaatgaagaaccataatacacattggagaaaaaaaagaactgatgaagctgtattcggaattttttgtgaataatgagtaaataaaaatggcgtattaatcccataatttgtgggagttaatacgctgtttttttcgtatattttttgtttgattaacattgagtaaactcagatatcatggtattatatataatattaaacgtgtcggtgaacctgtgagcaagggaaggaagccctttatgattggaggatgatgccatgaaatatgtaattgttgaccttgaaatgaatcctgtttcaaatgaatatccaaacgaacgaaaagtaagcagacttgaaacaattcagattggtgcagtgcttttggatgagaagtatcaggaaattggaagttttgtaacgctggtaaagccagagtacaatactcgtattcagaaacgttatgaaaagctgacagggattaagacaagcatggtagaatctgctccgcattttaaagaagcactgggtatgttctttaactggtgcggcagtattcaggatgaagtgcagattattcagtggagtgagaatgattaccttcaatttacaagagaattgcagatgaaaggaatttcagtatcagaacagaatcaaaagtacatggaacatgtctggttggattttcaggcggaatatgagaaagtgcttggactggaaagaaatatctctttaaaagatgcgattatgtatgccggagaagattttcatggtcatcagcatgatgcactggttgacgcgagaaatacggcctgtctgtttgggattgtaagagatgaagagaaatgtgagaaagcgttgaaacatgtcatcgaggtgttaaagccaaaaacggaagtttcccttggagatatgtttgacttctcgggtttgtcgttgtcggcataagaattaaaaaaagctgcaaagcgcaaagattaagaaatgatatgcgctctttgcagctttttttgacgtatattcgcaaaccaagctgccactcattgcccgagtgacagcttggttacttgctatccctgataccttattctttcaaccagcgtttcctttttcagattactgcttaaaacgcaggaaagtacaatctgcaacagaccgaccaaaaaaatcataataaaaattggtacgattggaacatgatagatattcattccaaatattccaatatgttttgcataggaaaaaagtgcatatccgagcggcagaccaatgatcaaagctacgcatatggtgccaaccgtaaaaatcagtccctgtaactgcaggcataaatttaattgtttattcgtcatacccacagcctgtaatacaccatattcctgcttttttgtcgtaatattcataatcatggtgtttgccatattcataaaaccgatgagtcctacaaccgccataaacagataacagccaagcttcatcatgcgggctgcgacttcggcagattgtaactgtgcatgataggtatccatttttatatgtgaagtattagaaatcaaagtattcagactctgttccacagatgccacatcttttttatcacagtccacccacagatagccataggctgttcctctcggattcatggaacggtatacaccttccggaataacaagataagtctccgcacttacaaaggatcctgcaatctttccctgataggtataggttccacttccattctcaaagtcaaatgcaattgattcacccggagcatatccatcttgttccatccacgtcgaccaaccaaagaaaatatcaccattctttaccgcctgatcatagtccatagagccaatatctccgtcttggcgcataaaatcaaaatcctttttactcacaatagcacccggaaatcttgttccattcagatttacagaaacaatctctctcgtcatgacatctgtcactcccggaatgcttttgatttcctcaatcagcgaatcattcaatggattatccgtcagaatcgtatccagattattctcaggatatctttcatcatactcagcagaatagtcaagctgcagttcaaattgtccatgattaacggaaagacgtgcttcatgctccgtgtcaatatttcccacataattagagataatcacaaacaatgtgcaggaaagccccattgtgaggatggtactaatggttcttttttgattacccgttacatttgccattgccatagaaaacacggtgacattttttctgccatttcgttttccttttttgtgtgtttcagcattttctaaataccgtgttgcttcgataggcgaaatccgtgaaacaattttcattggtttacgcagcgccaaaacaacggtaagaaatgatacgaaaatacatagaagcataacaggcagggaaaacagtggcacctgctgattttggactcccatagagccagtttcggttgatacaaggtttccctgttctaccagccagttaaaaccgcattttgcaatcagaaaaccaagaagcaatccaaccggtattgaagaaattgtcaaaaaaatgccctctctgaagatcagttgtttcatctgcttttttgtcgctcccagagccttgatttttccatactcctgtatcttgttggcaataccgacctgaaaaatattataaatgaccacaacagagaaaagtacaattgcaagaatcaaaaccccgcataccgcaatcgtttcataactcggctgcaagacccattgcaaatagagatcattgactataacgtttttttcttcgatcccacaagttgctgcaatctgctttataaccgaatcaatattattcatagatacatttacagaatcatttaaagtaaaataaatattatactgtctgtcattctctgcgacgtgttcatcataaaactcctgtgacccgaaagcaacataagatgcctcgatggtatactcatcccgatcatataggattccgctgacaacaaattcttccggcttatattctgactgcatccctgcgcggtaatccagtgtaaccgtatctccgatctttacatcaccataccccattgcacgaaaaaatgctcttcctgcggcaatttcctgcattttttccggatactttccttccttcaactcatattctttattataaggaagcatttttcttgcagtctcatccatgcagacaaacccgcctttttcattgccttttatgataccttcggtgcacatagtgcctgtagcatctatttccgcacggaggtttacttcttttaattgcgatccgtctgcggaaacaaacagaccataattgcttccatatgatcctgccgcctgacttttctgtaaatgaattactccatttcccacagtactgatgataacaagcagcatcgtggtcagacagattgccatcatgatcagtatacttcttgtcctgttccttttgtcattgctatatgcaatcctgcttattgtcttcatctgaaatccaccacctgtccgtcctcaatcaccagaatacggtcagcgacctgtgcaatttcgtcatcatgggtaatcattacaattgtctgtccatatttttttgctgtcatcttaagcagagcgattacctcatcactggtcttagaatcaagatttcctgtcggctcatctgcaaatataatttccggacgattcaccagtgctcttgcaattgctactctctgctgctgtcctccggataactgatttggcagattataaatccggttttcaattcccagagttgcaataatatcatttacatacgcttcatccacttttcttccatccagccccagtggcagtacaatattttcccagacattaacagatgaaaccagattaaatgcctgaaaaacaaatccgatttttcttctgcggaaaacagcaagggcatcttccttcatcctgtataaatctttccctgctaaagtaacactgccttttgtcggggtgtctagccctccaagcatatgaagtaatgtacttttaccggaacctgattttccaacaattgcgacaaattctccatgctcaatctgaatgtccacctgattgaccgctttgacctgattctcacctgcaccataaaacttacaaagctgcttggtttctaatattacactcatgtgttgcctccttttcatcctacatccaaattgtatcaggacaatctttcatttcactttcaaaaacgagcagaagtcttacagagttgtaagatttctgctcatttaaaatttaactaacatatggtaattgaatcacaaacgtgcttccttttttctttttgccggaggttaccgtaatcgtacctgcgtgtttttcgataatttctctcgatagaaaaagtccgattcctgtaccactcttttccatgacctccttggaacttcctctgtaaaatcgttgaaaaattttgtgatactcattctgcggaataccaattccctgatcttcaatttccattcttacaagatcgtttcttttttgtaaccggataaatatttttgaaccacacggactgtacttgaccgcattatccagaacgttgatcacagcttcaccaagccaccttttatcctgcataatcgtgcatgtttccagctctttttcatagtcaaaaacgaattcaatttctttctcatccgctttaggataagtgcggttcacagcagatatgacagtatccataagcggaagttttttcttattcatctgaatcagtccagtttccatcttggatatttcaagaagcgactgcaataatgtctccagtccatccagagcactccgacaacggatacgaaactcctcctgttctgtggcacttaagtcattctgcatcagcacactaaaacatatatccaaagctgcaaccggtgtctttaactggtgtgagatgtcagaaaccatttctttcgtgctttctttttctgtccgtgcttcttcctttagcaactgaatatgatgtccgattgcttcaagctggtcattcaatttttccagttctgcatgattttccgttttcagtaaatcatcaaatttattttcacggaatctgatcagaatttcttccaactggtctaaaattttctgatgacacgcatcttcttttttcttccaataaagtaaaaaagtcaaaaaaaacacgcatatcacagtgcttacagcaccggtcaccataacctgatgccggaattgtgaataaaatgcattccctttattcccccagtatccatattgctccaataattgctttccctgttcgttggtttcaatatccttatccttaagcaattccgaaacagcatccagcccggaaaattcttcctttgcagcaatctctgtcataagattcattttatatttataatcttcataaaacacatacgtggtaaagcaatttaatattgcaaacaatactatgacaggcaataccaaggagagtactactgtgatcttcttgcgatatctctttgtcactgccttacctcctgattccatatatacccaagacctctgatattctttatatagaccggtgtagccggattgtcttcaattttctcacgaagtcttctgatattgacagcgattgtattttcatccacaaaatccccttccagatcaaacacattttccaatatttgtgtttttgaaagaatctgtttcggattctgaagaaaaaaagtcagcattttcaactccgtttttgtcagactgatttcacgactctttatcaggactttcatttctcctgcgataaatacgatatctcccgaaatcatctttccggcttccgttttctcctgtctgcgacggaaatgtgcttctattttcaaaagaagtaccgaaagactaaatggctttgtaatataatcatctgcccctgcttcatatcccataacctgatccatctcctgatctagtgctgtaagacaaataatatatgtattataattgcatctcatccaccttacaaattccagtccattcccatccggaagattcacatcacaaatggtaacatccacattattatcacttgcaattctttttgcttttttcactgattctgctgaaaaaacctcatatccggattttttcagtgagaatgtaattccacgatttaaattttcatcatcttcaaccacgagtatatttggcatagcatatgcacctctctttattaactatatatatttaatatcagagtagatattgtttttataacatcacctcaacgtacttcatggcttgattttgatatgattgaatcgttccatcgtctgaatcaaagactctacgttctgaatttcatcctcatccagataataccgcttatctgcatttatcgttctggttaactgcatgaaaacactccttttctcaaaataattcgtcggttaaaaacataacaataattgaaatagtccttgatttatagtataattataacacaaatcaaaccattttacaatgtcggttaatttttagaaaggagaatttatggaaaacaaaacttatactagaaatgctcactcggtctgctgtctgacctattacgctgttttcgtcattaaatatcgaagaaaagtaatcacaccagaaatccttgcttttatgcgtagtcacacagattacttaatttcacagcgttatcatggaacacttttggaatttaatggtgaagaagaccacatccatatcctatttgaacttccgccatccgctgcaccttctgttattatctgtaatttaaagactcagctttcaaaggaagtccgaaaacgcttctgggaacaaattcacaatcaattatggaaagattctttttggagtgacagttacttcttatcgacaactggcggtgcaaatttggaagtattagaacaatacattcaacaacaaggaatcgaaaaacaaaaacggaaatacgttcatcacaagaaaaaatgagcattcatccccaaccgactcgtcggatggggttttctgctctataatagataaatgtataaagattttgcacagttcgtttttttcaaaaaacttattctgtttttcaactcctgtgatataatgctttattataataattcccattgacaaaatgaggtgaaccaagtgaaaaagaaaacacttgtgcctcttatcatttttttactgggcatatgccttgttagtttgattgtatacaaaacagacacccacgaaaaagagcagagacacataacagcacaattaaacgtagccacctatggcgaacaaataaagaatgaaattacaaatggaattgagatcacagataccttgaagcaaatcttaataagtgaagatggcgaaatccatcagtttgaaacaattgcaggaaatcttatgtctgattctattgaaagtgtacagctcgctcctaatggtgttgttacagatatttatccggctaatgaaaatgaggcaggtaagattgatttgattcatgataaagaccgcggaaaaatttcctgttacgccagagacaaccatacaatcattacgcagggtcccttcaaattaaaacagggaggatatggaattgcagtccgcaatcccatatacctgaaagataaaaacggacatgagtatttctggggatttactattgttatcctgcgtgttccggatattttttcagattcaatcagtgcactttcaaattttggatacgaatacaaaatttcaaaaacagacgctccatggagtgatacttataaagtggtttatcaatcagatgggcaaacaaatcatcctgtttcttatacatttacaataggagatgaaaactggaaatttgaagtaagtcctaaaagtggatggagaaatgccactctactgataatcatcatcggaatgtttcttacaataagccttctcctgtcagttcttaccagaatatggttagtagaaaatgaacataagaaaaagtttcagatactggcgcgcacagattctcttacaaatatttataaccgctatggatttgatgaatttgcagaaaaaatgattcaaaaaaatccaaaagcacattttgtggctgcgctccttgatatcgatgatttcaagtttattaatgatatctatggacataattacggagacagagcactaaagaatcttgcagacagcatgaagacttttttcccatccgatgcattacttggaagaaatggtggtgacgaattctgcattcttttaccaaattgtacctttgcagaagcagctatacagctgcagaaattcaccaaacttcctaaatcattctcataccatggtaaggaacatgcattttatatttctctaggatatgcagaatatccaacatttgcatccaatcgttcacagctcatgcgctgcgcagatgccgctctttatgaaataaaacttcatggaaaaaatggatgtatggtctacagagaaggaattcggacaggtgcccgcaaacaacttggattcgcattcaaggatatctctgaacatcttccaggtgcattcatcatatacagagctgacaaagaagatgatgaactattttttgcaaatgatgaatttcttcatatgtccggatataaagatatagatgaactgttcagacttactgagaaaagttttcgcaacttgattcgtgaagatgaacagcaacagatagaatcaagtatctgggaacagattgacaacggcaataaaaatgactatattcactttcatcttcgaaaagctgacggaacttatttttctgtgcttgatcatggaagaattgtagagaacccgcaatacggaaaggtattttacgtattgttcatggattggaaagatatgcatattcgttacaatgataaattcgcaagataataaaatattgcaaaaaaagagagcgtatgatctattttcatattaatacttggtttgaaaactgatggaagaataacacgatactgcgatagaataaggaaaacggttaaactaactattgctgagtgagcaacagcaaaagtaagcatgactggaaagtgcttgtgatcttagggattaagagaggatacagattatggaagattcttacgtattacaactgttgaaaccaaagtttaaagattttcatttgtgtttctgcggatttgcagaatgcaagccattacatagctacgggccagccgcaaggtccaattatattttgcattatgtaatgaagggcaaaggtatctatcaggtaggtgaaacgaagtatccgctgaaagaaggacaggcctttctgattgaaccggaaagccttaccttttatcaggcagataaaacggacccatggtcttacctttgggtaggatttggtggtacggaggcacagagatttgtcagagatctcggactgaacagtcgtcagcttacatgcgagtgtgaatatggagaagaactgaaagaaattgtatttgaaatgctttatcatacgagttcaactgcagaaaatctttattatctccagggaaagctctatcagtttttctcagtactggctcgcgggattgaaattcagcaatatgcggatgatacaaaagaaagtatacatgtgcagaaagcaattgcctatataaagaattactattcacagaaaatcacagtggaagatatagctgattatctggcacttaaccgaagttatttatatacaatatttcagaacagtcttggaatctcgccgaaggattttttgacggaatttcgaatttccagaggaaaggagcagctcgcacttacagatctatctgtggaggaaatcgcagtttcttgtggttatcgcaattcacttgctttcggcaaagtatttaaacagaaaatgggaatgacgccgacccaatatcgtaatgataacagaaaggctgaccgagaacgattgatcagtgcacaaaacgaactgaaagaatacaagaaacataaaaaaatttatgtaggagacgtcgaaaaagaatagacgaaatgttgaaaaagacatccgatacctaacatttgggatacaacacttaacaaaaaggtataacggatgtctttttttgtacgctatacttgtatcaacaaatataaggaacaagtgcacaggtttcttcactcaaataacaaataaacaaaggagtattggaggaggagaatcatggaaaatcaaaaagaaactcagaaaaatccgcaatataaatatgtgtctacaagagaaaaattatgttttggaattggagcaatcggcaaagatgcgatttgcaatttagtaggagcatttttaatgctttattttacagatactttatatttggcaccggcatttgtcggcgtactgtttttggtagcaagaatatgggatgcgatcaatgacccaatgatgggtatgattgttgacaatacacatacacgttttggtaaattcagaatctggcttgtaatcggaacattagtaaactcagttgtatttgttttattattccacagctttaatctgtcaggaacagcattgtacgtatatgtatctgttatgtacattttatatggaatgacttatacgataatggatgtaccttactggtcatggcttcctaacctgacaaatgacccgcgtgaacgtgagaaagtttccgtaattccaagatttttcgcaagtcttgcaggattttcagtagcaacatttggactttatattatcaattacctgaataaagttgcaggcgagagcaatctctacgcagaaaaaggatatacactttttgcaattattatcgcagttattttcatcgttacaatcggcattactgtatttaatgtaaaagaggaatcaacagtaggtatatcagcagaaaagacaagtctgaaacaggcatttcatgtaattgtaaaaaatgatcagttgcttgcatttatcggattacttttgacatttaacctttgtacacagattgcaaaaagctttgctgtatattatttcaaatgtgtatgccacgatgaatatctgtattctatctttggatttgcaattattgctgagatggcaggacttttatgcttcccaaaaatcgcagcaaaaattaaccgtgaaaaagtatacgcatttgcatgtggacttccaattgctggatttgtactgctcggtgcagcaggatatgtagcaccacagagtaaggtgttagttgttgtatgttgtgcactgcttttcttcggatcaggtctttcacttggagtaacaacatgctgtatggcagacgttatcgactatggagaagtaaaatttggtgtacgaaatgaaagcgtaacatgctctgcacagacatttcttatgaaggcagctacggcagcagcaggtggattaacaggaattggtcttcagattgtaggatacaacgcaaaagcggtaacgcagagcgcagcaacagtaatgggtattcgcgtgttaatgattgtaattccaatcattcttgcatttgccagctttggtatttacaaaaaatactacactttaaaaggtgagaagatggaagaaatcacaagaaaagtaaatgaaatgcatgcgaaaaagcagacagcttaagagtcaacaattcaattataaaaggggtagtatatgagacagattatttttcacgaggaaacgaaaactttccatttatacaatgaaaaaatcagttatatcttatgtgtattagaaaatggacatctgggacaattatattttggaaaacgacttcatgataaagcagatttttcttatctggttgagaaatgtgaacgcccaatgacatcgtatatatatgagtgggatcgtactttttcattggaacatatccgacaggaatatccggtttacggtacgacagattacagacatccggcaattgaattgttgcaggaaaatggcagcagaatcagtgagttccaatatgaaagctatgagattattgccggaaaaccgaaactctccggattgccggcaacttacacagagtccgaggaggaagcgcagacattgcgcatctttctgaaagacgctttgactggtgcaaaactggcgcttttatatacgatttttgatgaatatagtgcaattgcaagaagtgcttatattgaaaatgccggtgagaaaaatctgcatgtattaaatatgatgagcttaagtctggatctttcggataaggattatgaatggatgcagttgtccggtgcgtggtccagagagcgctatattaagaatcgaacattggagcaaggcataacagctatcgacagcatgcgcggaaattcttctcacgaacataatccgttccttgctttaaaacgtcacaacacagatgagaatgcaggagaagcaattggaataagccttgtatatagtggaaatttccgtatgcaggcagaggtagatacacataatgtgacacgaattacagccgggatcaatccagaaggattcgattggaaattagaaccaggagaaagctttcagacaccggaagcagttctggtttacagtgaaaatggattaaatggcatgagtcagacattccagaagctgtatgcaaagagactcgcaagagggtattggcgcgataaggcaagaccgattttaaataacaactgggaagcaacttattttgactttacagaagatcgccttgtagagattgccgggaaagcaaaagaatgtggagtagaactgtttgtcttagatgacggatggtttggtgcgagaagaaatgacagagccggtcttggcgactgggtggcaaatgaagagcttctgccaaatggcatcaaaggtctgtcagaaagaattgaagcacttggattaaaattcggcctttggtttgagccggagatggtaaataaagactctgatctttatcgagcacatccagactggattttacagacacctggaagaaatacatcacacggcagatatcagtatgtactcgatttcgcaagaaaagaagtagtagattatatttatggtatgatgacaaagttattatcggaatcgaaaatctcatatattaaatgggatatgaaccgaagcattacggaatgctatagtagcaaacttccttcagacagacagggagaagtgttccatcgttatattttgggtgtatatgatctgtacgagcggttgacaaatgagtttccagaagtattatttgaatcctgcgccagcggtggcggaagatttgatccgggaatgctgtattatgcaccgcagggatggacaagcgatgattcggatgcaattgagcgtctgaagattcagtacggaacttctatgtgttatccgctcagcagtatgggaagccatgtgtctgttgtcccgaatcaccaggtatttcgcaatactccattacatacaagagcgaatgtagcatactttggaacttttggatatgaactggatctcaacaaattgacagaagaagagatcaaagaagtaaaagaacaaatcgcatttatgaaagaatacagagaagtgttacagtttggaacattttatcgtctgaaaagtccatttgaaggaaatgagacggtatggatggtgacaaatgaagaccgcacgcttgcaatcgtaggctactatcgtgttttaaatggagtgaatcagccgtatagccgtgttagattacagggattggacccggatatggtttatgaaaatgtatggaatcatacagaaaattacggagatgaattaatgaattatggattgatcacatccgatgtgacagctggtgaagtgcctgggaatgtgactccttgtaccgattttgaatctagaatatatatgctgaaaggcaaaaaagttcaggagggaagatagagcatgacgaagacaaaaagaatcagtggaatggtactgggaatattgtttattggattatgtgtatctttcttacgactttcacaatttggcgtggatccattcagtgcaatgaatctcggaatcagcggatttatcggatggagctttggaacgtggcagttgcttgtcaatgcgatcattcttgtagttgtattctttcaggcaagatcctgcattggtgcgggaaccattatcaatatggtatttgtcggatatattgcagattttatctgttatgtagcaaatgatgtagtgcagattcagatgaatctgccactgcgtatccttgcactgctgattgctcagctgatggcatccatgggagtggcattatatatggtcgcagatatgggaatcgctccatatgacagtgtcgcaattataatcgagaaactgacacatcaaaaaatcccattccataaagcaaggattctttcagatgttgttgtcgtgattatcggaatcatatttgccactgcatctggggcgggaatctggtcggtagtagggattggtacaattataaatgcctgcttcaacggtccattaattcaattttttaaaacaaaactggagagattttacttgtaaaatctaaggattacaattctccaattcttgcaaggctcatatccagaacggatacgggcctttctttttcaccagtagcttcatccaaaccttcatattgaataatgaacccttctctttggtaaaaagaaattggatatcttcctcctatatgatacatataacagcaaaaacaaaacatccaagagacggaaggagaatatgttatgaaaaaaatattagtagttttattatctctcacattaatatttgcttttacaggatgcacttcatccaataatggagcaacagaagatatagaaattaagacacaggaagttgtaacatcaaatacagatgacaatgatgataatatcagtaacacagaaaacgcagtagagaatgcgaacgaaaaggattatgatttctcttcttatgaaaacgatatccgtaatataacaaaaagtgtaaacaatgcaaaaacatctacaaatgcatctgagaatcacgaacaattctacgctttgaaaaaacaggtagacgcagtcgatgacgaactggataagcttgacgatgaatttgagtatgcttaccagatgaaagagattagcttcgagacatacaaagcgagagaacgcacgattgaaagactggaagatgaactggaattagcagaagaagcactggaaaataaatacggaattgatgattaattccatatcgacttcttcagaaaccatatctgtcagggaataaccagaatcgcccggcacagattttatatcaccttcttgaattttacttggaatggatgcttgcgaaatgctttgagtcgttctactatggtttcgactttccagttactttttatcttttcaattacgccggagtaaacaaattaattcgattactaacacaagtgatagtggcaccatatgaataatcgggtattatgaatataacataatgaatagaatattcttaccggggaggcgaaaaaatatggataaaaaaaagaatgaaaaatgggaaattgtaggcgtatagctgttatttattattggattggttggatgcatcttctgcatattcaatgaaattaataaacaaaaagagtttgaaaattctactgatattcgaagtgtgagtgcagttattactcaagcaaaagaagataaagagtctagcaggataataaaatatgatgttaactattcatatgaagttgaaggggaaacttataaaggaagaggcaccgtttatcacagagttaaaataggagatgaagacactataactgtttatcgaacttcaaagggtaaatataaaatagaaccaatagacagtccaatcgagattcttatagctactataggcgctgtgctttgtatatttattctggtagctatgacggttggcagaatattggaaaaacgagataaagagaagaacgaagaatcggataataaagggaagaagtcaaagagaaaatagtaaatgactaagagaagaggatgtagaaattggggagattatccggggcggacagtctccctaattatcatatagtagttttaatgacggagacattatattaaatacggacatagccggtggatggacctgcaccgaccttattatcaatcaccgtcttaattctatccggcttggaaagattatggtacttcaaatgctctacacggctttcaaattcattgtatgctttcagtatgatacccagataatatttaacaaaaggctcataactgttttcgccctcatgccagccagtagaacttgcttgaagagcttcataatatgtttcttttgtcttttcaatcagcatttccatactgacatattttccaacgatatatcccgccttataaaaaagcagtaaagtgagcaaacggctcatcctaccatttccgtcattgaaaggatggatgcacagaaagtccagaatgaacataggaatcaaaaccagtttatcaatgcggtcagcttcccatgcttcaaggaagcgagcgcaaagctctttcatcgcttcagcagtctgaaatgcgggaactggaataaaacgtgccttctgatggccctcgacatctatttctgcaattacattatcggaattcttataacttccaccagcagccccctgtgaataggagtacagatctcggtgtaactgcaaaataatgttcgattttggattgatatattcatagccttcgtgaattgtggaaagtacctcacgataaccagcaatttcctgctcagatcggttgcgtggctctgctttctgacttaccagttctttcaaacgtttatcacttgtaaatataccttcaattcggttagatgctcccgtactttgaattaaagcaacttcgcaggatttgtaatataatcaaaatttctcattgaaatctccttcattttgaatttatctccattattttaatgctaaatgatggagatttcaatggatttgatggagatatattctccatatgcacaataaatatattaatttggatatagaatttattacttcatcgtcttcgccagtgaattgagtaacgcccgcatctctggatttgccaatatttttgccagaagttccggatcgacttcatcagcaacagtagtattattgttttcctgctgactcctaagatttcctgtaactcttgaactgtataacatcttttttctgacatttctttatcctctgttctttgaaatatgaaagaaaaattatcccttcatataacgaaacgctcagagcatgttttacagtggtcaaaagcaagttttttgagatttctgcatttttcctgaaattaagtaaagaatcaggttgtctttacttaatttccactttcaaaaaataaaaaaattttgtttttgaaagcggcatcttgcatatactattagcagacagtatatggattatgacagagtatatgggaatttgaatccatacactctatgatttcataaacttgaatttatcgatttctttattatctaatctgttagtaatctatccaacagcatctgcctattatttataaatatttctgttacctggtaactctctgtatcctcatattcgcacagatgtatgcgtccattatcaaaacaatagatatctgcatctggtattcctaacaaaattggcgaatgcgtaactataataaactgtgctccctcttttgcacatctgtatatttgcatcaacaatgtaagctgtctctgcggcgataatgcagcttccggctcgtcaaaaagatacaagccatttggattcatattattctgtgctaatgcgagaaaactctctccatgtgatttttcatgatatttagcggaaggatgtgtaatatctgcatattcttcttcctgcgttgcaacattataaaagctttctgccctaagaaaatatccccacttttccttccgatagcctttggcaattcttatcgcatcacacaactctgaatgtgtatcatgcgtagaaaaaacataattcttcgttccaccctcaggattaaaaccatgtgctacggcaagtgcttccaataaagttgatttaccgctgccattttcccctacaaaaaaagtaattggtttgttaaaatcaagtttttcaactcccttaaaagccctgatttccttcagataactatccttatcaattttatcccaatcaaatattactctttgtatgaattgatcattcacctaatcatctccttgtaaaaaacactttctaatccccatcttcttgtcctttagacaagaagcattcttcaccttcagttcggtcaatcccgatttctatttttgtttccatagcatggtgtactctttttcaccagtagcttcatccaaatcttcacattgaataatgaacccttctctttggtaaaaagaaattgctctggcattcttctggtatacatttaatcgtaagctaacttttttatccttaatataatccaataaaagtttacctatgccacatgactgcatttcatcagagacaaaaataccttcgatatattcatcatttagtcctacaaatccttgtatctttttatccgcttcaaacacatagatttcggattgtaacatcatttcttttactagttcataattacttttccagtattgattggaaataaaataatgtgctttcagatttgtctttaaccatatgtcagcaactctatcaatatctccgttcagcaactttctaatcataaccaatattctccccaactacatcctttatgcttttctctttttttcattctatcacaagctcaccattaatcattatttttttgatattttttcttttcccccactgcaaaacaggctctgagcgtttcgttatatggaggggtacatatacagagcaagatctacccatgtattaccgtatcgccattttatggctacggcatacctccgggtaagtctcttgacggggattccgattccccataccctccttgtacagacatcaaagatatctgtaggctctctatcaaagataatcgcagcactttatataaccggaagggacagccggttaaaaagtgtaatcgcacatccaagatgtcttatctaaaaggaaggaggactatggcacctaagaagaaagaaaagaatctcaagagaagtaacatcatcacattaaaactaacggatattgaattggcagtgttaaatgaagctgctgactgttttatcagaaacattcagtcgttcagccaaatccttttgagtcattccattgacttttcgtaaagcggcaataaaaccgccgatggttttcttttccatattgagtcctccttttggataggtggtttgctttctacgtctttattctaagattttagtagtgagaataccacccaatagactcagaatcactctcagaatccgagaattgactgtttccaggcacaaacaactcaaagcgacttaaaatgccaagctattcgcattcaacaagaaatactttattcccatgatgacaaaaccttcatcatttctccaaggcttcttactgccatttacaatgacaatcttcttaaaagagtctgggatattacgcagagaattaaactcctgagtctgcttttcttccgaagtcatgtcataagcaacctgaatgtaatacctctggttgccttggttcaccacaaagtcaacctccagctgcttacgaacacgcttgccctctttatccttatcgaagatgtccacgacacccacatcaacattgtagtcacggatcagcagctcgttataaacaatgttctccatgatatgagtaggctcctgctgtctgaaattcagacgggcatttctcagtccaagatcagtaaagtagtatttcagatttgcaccgatatactttctgcccttaatatcgtatcggcttgccttggaaatcaaaaaggcatctgtcaaatggtcgatatgcttggagatggttttattagtataagtcatctggcgctcactggcaaaggtattggcaatctttgaagtacttgaaacacaccttaggatctcttagttcctcattttcaataccatccaatgcaatctcaataatatgatcagtatcaacatcattctccagtaagtatctcttaaagatagtaaacagcaaaaaggatttgccacatctacgaatgccggtaatcacctttatcattccattatcttttcgctcaatcagcctgctatatcgttattatagttaagctgaaacacggaggagatttcaaaggggcactatctttttggagaagtataagtgatgcttttgtccaaggaggtttcttatgaaaaaatgttttctttagtcctttgcactatccttactcctttctttgtctactactggctatgcagcagtaaatgatgattgcaacaatatcactattgacgttttgaagaacatttttattatgacggagattgtagaacagaaaattgtatcaggttgcaaaaatctttcctgagatcaagtaaagaaaaagagcatatagatgaaccgccccccagaagttagacccaaaaatctaactattggaggtcggttcaattgtaggctctttttttacattccaagagttttgatcactacctgtgccagaattctggcaagataatcattggggtgatttaaccagtttccggttatatcaatgtatcgttttctctttccgatttctttttgaactgcctgtatatctgctatagcaactcccataccttctaagcccttcagactttcactgtattcatcctgatgtgcccagaaatggtgtggctccgtagcagccagttcattgggaagcgtagacgcaatcaataaaaattccgttttcggactaaccttccggattgcctctatgagtctgcctgttttatttctgtattcttccataccgcaacggtcattcattccaaaaccaagaataaccagatccggatggaagttggctgcacgctgtgatgaattttcgattgcccattcggaatccactcctcctaccgatgtgttgtggaagcatactggactctgccatttttcctccatctgatggaacagcagttctgcccaggtaggctgtcccggcttctgtccatacataccgctgcagtcacagccacagcacacgctgtccccatacaaaacgatcttaacgggttctcctacttccagctttgcagagagcttcggcagtttgtccagttgactttccggagcggaaagtaactccttcttcgttgccttataggtaacggcgatctgtttctctgtaacaagcttcggattgcctatggcacataggtttaagaattttccgttggtagtcactagcggaccgaaatcttttgcaaattcgcttgtttctcctgccttctttgccgtatcaaagtccggataaaggaaggtatcccatccggttactggtatgtgactcccttcaggaattaccagctcatctccctctacaaggtaatcgatccccttttcatatactgtttcccggtcatagctttctacggacaaaacttcttttggagtccacaggaaagaagccctgcatccattctcatcagcaactgctgcaaaggtttcccggaagcaatactcaccttcccatatcggctccagccattctttatggaaaatctttcctatcgaaagggttttcttgatctgttcttgtaaaaattccttaaagggtgtcacccatccgcagttcactaccggtctatctgacatgaagatcatctcacagggcttttctttttcatatggataccagtagggcattggttttccgtccgcatcattgccgtttggatcacctgtttttatgaaattcacccagtaattgcacatcattctggaaagatcgtaatgctgcccaacaaagggtctccagcatttcgccagtgtttcaaagaaaaaccataaatctacagaatggaaggttccggcattatcccatcctggaatatctggatcaaacctgtaataatagtagggctttttttcacctgcactttttttatctgaaaaaagacacttgatcgtacattcaattccgtttaccttcgcatactttccatcagaatcctcccgcattgcctcgggaaagcgcaaaaaggtctcagcattctttccgaaaatctcttctgccttctttttcaaatcttcttttgaggaagcttctatataactgggaaattcatctgaagtatttccagacataacgggaacatttacatgcttgccttccatgaaaagaaccattgggtcacctacacagaacttgtgatccaatacggtaaacatagccggaaatattttggtatattcctcatacttgtcacgaatcgtagccgcatccagcttacgagcctgctcaatagttgagcaacccaggaaagaaagaaaatgctgtccgttttcctcagcatgccacaattcctccggcactccgattcctccaacctgataaggagagcgaatcattgcactcatcactactgcacgatgaaataagcctttattattcatacatgccatctggctcataacacttccgcctccggctgactgtcctgcaatggtcacattacccggatctccaccaaagaaagcaatatttctctgtacccatcgaagtgctgcctgctgatctagacttccaaaattagtcggtgcgtcagggtgctcctctgtcagctgaggatgtgccaaaaatccaaaaacattaactcggtagtttaccgttacaactaccacaccgcgacgtgcaattctctctccgtcaaattccatttcggcaggatatccacactggagtcctcctccgaaaaaccataccaaaaccggctgtttttctgttacttctttagcacctgtccatacgttcaaatacagacagtcctcatccatggcaatttccggatccacatgccactcacggatatacacgttatcaccgattcccgggacgctctgcatggaaatcggagcaaagcgatagcattcacgaactccatcccagtcttcacagggctggggtgctctccatctgttttctcctaccggaggagccgcaaaagggattcccttaaatgcagttatcctagggtctgcggcttcaatacctttcacccatccattttctgtccgtactgttctcagcataattcctacctccgctaattttactattagccatgagcaaaactccacatactcagtatttatgcatgtttgcgaggcatggcaacctctctcaatgacttataagttactacagcacatgcaataacatagattatgataactcaaatgatcttaatgcagcatttccgttaccgcgataggtcaggtaaagcgcctgtattccatccggaatcgtaatcggtgcggtatatttttcccagacattggtatattgaacctctaatgtcgccagtacctctccatcccatgctgtctttacttcaaaagtgccatctgcatagccccggatccaaatactgatttcacgaatatcatggcagtcaaaatatttgaagccgatagtagttgaatctgtaatattggcaatatatccaacttcttcgtctccatccctgccgtcctgcattactcgtggaaaattcccttcgcccacataaactgatggggtatcggtaaacagattacatgcaagataagcggggtattcgcctttaccctcaagcggacctccatttaaaccgcaggaggtaatttttacctgtggaatactgccgtccggcataatctgaagcttttcagcacatccctgtctactgtaccaggtattattggtatgcctgtgataaaaaatgtaccagtcctctccgatctgcacaatacttccgtgattattggcaccgtaagctgttggcatatctgccggcttgtaggtatcgatgtgcagatcacaattgctgacaataactccgccatagacaaagtccctagtaggattcttgctggtggcataacataattcgtgcattaatatggatgaatagacaaaataataggtgtcacctactttacggatggaagatgcctcaaaaaactcatgtccctcaaatccggtaccggcaccatattcacagccggggaccacaaacaccggagcttccctgatcgtcaacatatctgctcccaacaccgtagccatagctccggtacgggatttatcaccttttccgcaagctccggtataaatatatgtcatatctccttccgtcagaacccccgggtcaaactggggctcatcaccttccttttcgcccagacgtgtgccatcttcataatgaacatagccataaaattcatactttcctgccggagtatcacatacagcaactgaaactaccgaaaccttgtccaacacgtaataaagatagtaccttccgtctggtcccaccgtaacatccggggcatacagacacattttgccttccgggttcagcggatcggctgtcttcggataaatcacaccctcatatctccagttgcccaggtcatcgaccggagctgaccagcacacatagtctcccatgcagaaaacatatccgttaaagtaatcatgggatccgtaaacatatacgcgatcgccaaaaacataaggttctccgtccggaatatactcccaggacggtaaatatgggttaaacgcttgttttttcactttgatattctcctttgcaagcctaattcatgtacattgtttcataaagcaaattactgggtgctagtttaagccttcaagctgaccacacgatcatagtcatatcctcgatctggattcacctttccggcattcagttcgaaataaaccacaccgttttcgtttacaggaagctctacgcagatatttccgtcctcctgctttttacgctctgtttttacaaaaggtctggatgattcccgaatcagcttcgtctgttcctcactcagattggcaggttctcccatatcatgccataccttcaagggattacatgtttcctcatctaccgtcttagtcaggaagcagtactcctcctgttcagccggaaatgtaaactccaacagcattttttctttaccctgttctgtacttttacgggcaatattccaggctacacctagataatcaccgtttgcacgtttcaaaacgacaatattgtcatccttatatacacaattggcttcactttcctcaagctttttgtaaaaagcaaatgtccagaaggtcggcttggtaatacagccattggcaaccagtccaaagccgccgtggaatggtgtaaaaggaactcccagctcttcaaacacatcaccaaatgtccagtaggaataggattcattcacatctcccaatctggaaagctgctgtgctataaaggccgcattcaggtttgtgtcatgaatgacgccctgaggagtataggagctgttgaactccgtgatatgaatctgcagacccttatattccgggaaactgtcaataatatctctggttgtttttaaattggcaaagccgtcctctgcattcatcagttcagaatatgcataatgtccaatatattccggcggatcaacggtgtaatgatgtctggttacgaaatccacaggtatgtgattctcatggcaatattccataaatgcctgaatccatttctcatccgttcctccacaaacagcagggcctcctacacggaatcccggattcacttcctttatggcatcaaaggttctatggaacagcttaaaatattcctgcatatccgcattttcccagaagccgcaaagattgggctcgttccatacttcaatgggccattgaataacttcctcttctccatagcgtcccatcagatgccgcagcaatgaacgcaccatattacaccatatatcataatcttttggaggagtggtatttccctgccagtaaaagatagtctggcttccatttgccaactttttaggcataaaacccagttcaagaaaaggtctcagccccaccttcttataggcatccattactctatccagataagtatagttgtactcgacccttaccttaccatcctcctcataggtctgaaagattgccatatcatcacagaataatccatgtccccggatatgcttaaatccgatttccttttgaaccaagcgcagctcctcctgatattcttctgtcaatgcaagccccattcttccggttcccacacaataatctacattattgtgaaaaaaggcctttgaatcctttgtaatcacgatcttttttctgtcatgctctgttgccccaccaaaatttaccatgcatgtatctccttcttctaaatcatgttcctatgcagtcacgcatcagatgtctgaccgctgcacgatccgcagctctctgatgacgattgccatattaatatgatactatcgcattgatttaaagttttcaatgatttatactataagaaaattgatatatcctctgatgtatcagaacggagattccagatgactgaaattgaatttgtcggctacagtgccgttcacccctcagattttatatatgatgttccgaatggctttacaggctatcttctgcttcttttcgactctccctcggagctgctcatagacggaagactaatgcggacagccgccaattctgctattctgtatacaccaggaagcaggatttattaccgtgctgccggtgaagaataccggaatgactggattcgttttcgttccgatcactccttcgtgaagctgtttccgttaacaaacaccccatttcccgtaacagatccggaatactgtcatcagctttttaaattactaacctgggagtccgcctttttctcctctgaaagcgaatcaaacattactcacctgcttcgggttctgttctccaaattaagagaaggaatccagaatgagtccccgggtattcacgagcatgagctggttgcattgcataagatgatctacaataatcctcagcttccatggaatataaacatgatggctgcgaagcttcacttaagtcccagtcatcttcagactctctatcaccgcaaatttggctcctcctgcatggacaatgtcatcgaaggacgtctgcgccgtgcaaaggatttattagagtacagcgaatactccatccgcgacatttccgagcaatgtggttataataatgtagagcatttctgcagacagttccgtcagcataacggctgtacccctggacaataccggaaaaatgcatcagcgggaagcaacaaaagacttctcacccacaataccctgggaggaagggagtttgagaagattaatcgaaatcatccggttgcagaatcttttccggttctgtgacgtcttgataccggacatatcgggatgaatcaacagtatattctttcttattaattttaaagttcgggaaggcccattccataagccttctccaaagtgactttttctcctccaacatcatcaatattttctgtaagttcttctccaccggcatacattcttccaagaccgcataaaattttatcagaacatgtataaaaatgacctgtaagtgacattgattcagaaccgtcttgagtacactgtcaaagttgataacaacacatctgagaacctgcagtccgctgaatcccgtatccgtgatactgatatggcagatgagatgacaagattctcgaaagagagcagcaggcagctacttccatgcttgctcaggcagaggatgaataaaatcttctttttcttctttttcccattgcaaatcccacattttcctgtatgatagagatatattaacaataaggaggcatacagttatgttgcagattaaaaatccggttttgccgggatttaatgcagatccatccattatccgtgtggatgatacatattacattgcgaactctacgtttgagtggtttccgggagttcgtctgcatgagtcaaaagatttagtacattggaatcttcttccatccgcattgtccacgacgacattgcttgatatgaaaggaaatccgtcatcgggaggtatctgggcgccggatctttcctatgcagatggaaaattctggttgatttatacggatgtaaaagtaaccgaaggaccgttcaaagatatgatcaattatctgacgacggcagaagatatccgcggaccatggtcggatccgatccgtgtcaatggtgtgggatttgacgcatcgttgttccatgatgatgacggacgcaaataccttgttcagcagacatgggatcatcgcgaataccaccatgcttttgacggtattacagtgacagaatttgacacagagacaatgaaattaaaaccggagacagcacgtacgatctacgccggaacggacgttaaactggttgagggaccacatttgtataagatcaacggatattattatctgtttgctgcacagggtggaaccgtttggacacatcaggaagtagtagctcgttcaaagacgttagatgcgttgagttttgagacagagcctggcgatccgtttattacaaactttgatacgccggaacttgagatccagaagcagggacatggtgctctcgtagagactcccggcggtgagtggtattatgcaagtttgtgtggaagaccgtggcaccacgaaaatgaaagttcgatcgacccacgcggctggtgtccgcttggccgtgagacggcaattcagaaagtatactgggatgaagaaggctggcctcgtatcgagggcggacatggcggaaaagtgcttgtggatgcgccgaaagatgcaatcttgacagaagcaccggcagatcattcgatgcatgatgaatttgacacaccaaaacttcatgatgagtggaataccctccgcgtaccatttaccgaggaaatgggtacgacaggggatggcaggctgacattggtcggaaaaggatccctctgcaataagcatgagctttcgttggtggcaaaacgctggcaggcatttaactttgatgccgaagtgaaagtgaaatttgatccgttcaactatcagcagatggctggattgacaaatttttacaatgataagcactggtcattcgctttcgttacgtggaatgagaaaaatggccgcgtgatcgaagtggcagagtgcaatcgtggcggatatcgttcgttccttcgcgacgatgcgattccggtaccggatgatgttgaatttgtatggcttcgcacaaaagtaagaaagcagtcttacagctacgagtattcctttgacggaaagaactatacagagattccgggcacactggatgctgctgtattgtccgatgattacgtactccagtcatacggtggattcttcaccggagcatttgtcggcatggcatgcgtggactactccggatacgatcagacagcagaattccgcagttttgactataaagaactggattaatcaatagcaagagccttttttaaaccaggctcaatcagatggctggcgatgccgcagaggattctgggaaaaaggacgaaaagtccgggaaccaggaagacgatgaggcaggcgccggccattgtaaataataagatgaaagtttctttgatgtgaccagccatcaggcgcacggagagcagaagaactgccggaaatgaagcgcgcaggtgtgagatcacggcaaagatataattggcgagaacctagaggacgaggcagattaccatccataaaaagggcggtaaaagattgccgttttttccggtaaagacttgggaaagatctaattcatagtcaaaccgaggcctccttgtgcttagagcatatgaagttttagctttgtcttgtagtttacgaatatccgaaaatcaaaaaagccctttgagaaaaggatttctcctctctcaaagggaaagttggcaaacttgaatttctatttgtgttgccatgtcattacataatctttttctccggtagcctcatctaagccactatgctgaatctcaaattcttctctcttataaaaagatattgcccgtgcgttcttttggtatacgttcaagtacaacttattccttttatcctttgcataattcagcagaattttacctagaccctgcgattgcatttcaccagaaacaaaaatgccctcaacatattcatcatttaaccctagggttaaacttaactactattttttctttgcgatataaaatacataactgtaataatctactactaatctaaaataaagcgattataagctatcctttttcctgtgtttgttttaaagttttcatctatacacttttttatcttttcctgttctttttctttatccataaccgttaaattttcaagcaaatcagcttcccattgtatttgaaaatcaagtccatcaattttagatggagtatgatggttgcctattataaagcatattctatcaatatttttgttatagcctaccttttttaatatttctttcgctacttctggtccttccttttcttgatagacaccatcaatagaaccgtattttttttgtgcttcaaccgcaccaatatcatgtagtatagcaataatactgatgaattctttttcttcctctccgatattttctcctttcattatatcttctgcatttttcaaaactttgagagtatgctctatgccaaaaggaatttctttgaatacttctttcatctctataataattttttctttaaacataaattacctccatttataccttataggtgttttagttctatctatccacttttttgttcgccgatacaatcagcatcatgggacggcgcatttcatcctgcatccccggaatatccatcatgtattccggtggctgcggctccacaatatgatttattataaaaccatttgaaagcagtgtatttagatatgtggtcagtgttctatgatattttgtaaccttttctcccaaaaacacagctgtccgtttgccctcataataataattatccaccggaaaatgcagtatttctcctttttcgttataatgccagtcttgtgttccataggcagtaaaaacaggatctatgttttaccttcccaacttctaattttttacatcatatcccaaaagccttgtcgtactcaataactccatttaatttgtttttacttccgttaagattaagtgccataaaactttcatcgtcaacttcaaatggcgcttttattccacactcacttgccggaatatatcctgcctttggatagtatttggaatgtcccaaaacaactgaatattcatatcccaatttatgtgctatactgtgtccttctttcatcaaagataatccgattcccctgttctgataatcgggtaatacagaaagaggggcaagcgcaagaacctcaaccccttgaacaactgcttttgtaaaaagaatatgtcctacaattttttcgtcctcgacagcaacaagagaaagttccggaataaacgatttgctttttcttaacgcagcaactaagttctgttcatttccatctgtatattcagcattttcaaatgcttcttttacaacatgatataccgtatcataatcttctggtctttcttgtcttataatcaaaatagatacctacatagttttaagctttttacaattacaggaaatggcaaatctactatctacctctcaatttttatggctctgacaatgataatatccgggatttctttattaaaatagcattcttcgtaaaatccatctatgacaaatccggtatcaaaacacagattaaaaatatcctgtaaagaacgatgataataacattgtttttgcggctgtccttcaatcgcaatatcgtaatagctgtgcggcgtcatatatttttctgtaagcgttacaaaacaggggtgctgtgtcgcaaatacaaatactccgttatcctcaagcaatttataaacagaggtaaaaagcggcttaatatcggtaatatccatgaccgccatattggagactgcttttgtaaacggcttatttctttttaatgccatcagacttgtttcattcgtggcgtctgctacacaaaactcaatgtgatcagcataccgtttttggcgcttttttgccagttccaccattttctcactataatcaaaagccaaaacagagacagctttttctgcaagatatgcagaataatttccatttccacaggcaatatctaaaatatagtctgttggatcaggatttagaagctctgttactttggggcggacaacttctctgtgaaaatcatttgattcatcccccattgcacaatcccaaaattcagcgttttgattccagattgctttactttcttcctttgaatactgcataatatcatctttctgcaaaattactttttctccttcgccccatggctcctgaaatgcgtgataatgatgttccaatatttcatctgttatcacaaacggcgaattggcatttaagacctgatttcttttatatagtcttttttgcaaaagctccttactggctttcatatagacaagttccgtttcagcgcctgctttttggatcagctctttataaaaattccgatttctcagtttcaaaaactggaagttataaacatctttgcaaatataccatatctattaactgtacaccacactcataaattgggtggtcataattgtccgtaaagaaattcggaatattgtgagatcggacaaatccgcatttttcataaaacggtacggtcaacgggctgtcacctgttccaacctgcaaaatagaatattcatctgcatatttacttgcaaggaagtcaatcaatgctttcccatagccctgtccttgattctgaggatcaactgcaatatttttaatttcaagtattccattatcttcatcagtaacaacacattcagcttttacattaccatcttcaagtacatacatagtacctttttcaagatagtgatcaatcatattttcctgctcatcagctaataacaataatgctataaattgctttttattctcattcacttctcggattttcatatttattactccgtcaaactgaaagtttctttttcttgataaatggggattagttttccttttttccaatcagcaataaccacctatggtcaaagcatatttgtccctccttgatatagggattaaaacctgttttatctccaccattcaaatcgtattccattttatcaataatatctttttgaatatcctctggtgtacttgtcaaatccatccaactttgtagatttacaggaacaagtgttgtttcttcaagctgaagctcaaaagcatcctcaaacaatgcttcaaattcttctctgctaagtattcttgtatgtgagttatcacgcatcgtttcaatagcgtcattagtttcacgcaattcttctgtagtcgctaccatatcccaaataacaagttttccaccttttttcaaaactcgttgcatctcccgaaaaggcttttcaggctcaacaaaatggtgcaatgaaagtcttgtaatcacaaggtcaaatgtttcatcttcaaaaggtaagcattccgcattccccgatacaaatgatatgttctgaataccttcttgctttgccagtttttttccctgctccaacattgcttctgtcaaatccaaacaagtaatgtccttaacataaggagccactgctcttccacatatacaggttccagcagcaacctccaatgcatgttcattgccctttgcctgaatactacgaatcaaataatcggtatattctgccttagacatatgatatgaagcaaatttctctgcttgtgtaccaaatgattttttcacttcattatagttattcataaacttttacctcgctgtaaacttcaaagtttctgttccttacaaacttgaatttgacttgcctattttcttaaaatctcatgtggagcttctatttcatttgccaaggtatgctctgttaattctgacatcaatttcaattttttattaatcaatggtcgcatacaattaggaacatgttcctgatgcgctctgtggattgctacacattccttacagtttccgtgataacgacaggctttcaggcaaggacagtgatctttgtctttatactccttacgaaattccgctgcaaattcttcttgcagtctcagcccctcgacacggtttcccttatgaaattctaccattgcatccagttctttctggttcccttcaatcttcatgttattatagcgcctccatttcaactattcctcattttctgataaattagaattttcaaattagtctttgcaaataacctttgaaccttcaccatcaattacaattccctgacggttgttaatcgggcatagattcaaatccgaaaactcagtcattattttctcggtaactttcttaaatggtgctgtaagataatgcggaagaacatagaaatcaatcaaatcaagccctgcatcatcttcttgtgagtagtcctctggcttttcatccatttgctcgatatattggatgcttggagcgcatataattgcgcctgccgactcgccgatcatcaattttccatttgccaattcctttttcagtagcccatcagttcccgttttacggagctggtccataagaaagaaagaatttccgccggtaaaatatatcacatctgcttcttcaaaaacagactgtatcgttgaataagcctccgttgaaatatcaatttcagttacgattgctcccaactttttgaataattttcgagccgagccggcataaccggtgtagccttcacgcagtgaagctgttggaataaatgcgactttcttattttcaatttcttcctttatcagacttcccacacttgaaaagtgcgaacataaaaatagtttcatcaatattctcctttataaattccgatttgcacatcaaatcgttttcttcattctatcacaacttctattgatccgccatcagtctttcgaaccaggtatccatgacaatgataaactggcctgttcctggcaattcttgcagcatttcatcaagagttttctgtttcacatatttctgcacatacacccaacaggcaacgctactggcttctgatacaatgtcagctatggttttgcgcataagctcttcaaattcagcaatttcttcttttggaacaacatcatacagggttggtgcctgatccgttctctgtgaagattgaaatctaccatacttaaaatggaatacagaattctttttctgtatttcggtataaatactatgtgatactggcatttccatcgggtatgtgataaacttctattgtccatttggaccgcctcctttgattttgagtttggcttgcgacaccattctcatcatatcacaggaggctttattttgttgtcctcaccgtctccacttattccattctccccagcatagctgggggattagacttttcattaaggagaaggataccaagtgggcagtgggcaatacggtggattattcatcgtttacggtggttgtttgctcagttttttggaatatagatgattttgtcacaggcgtaaagttcttctcccccgctgtttcgcatttcatatccgatatatttacaattcccatccaactgactataataaagaatgtccgtttgcctgcaaaggcgcggaaccatatccatctgcatcagggcgatatgacagaaaaatgaacttaaaagaatggaagaaagaacaatggatgtaattgaaaaatttggaaatagggtgagcagccaggcgcttaaggatccagaaaaagcgcgtcggctgcttcttgcgggataccgcctgcaggaaaagaagcttcagtttttgccggatcgggggctaccgtcgtcgggacagtatgtggcgcgggtggttatgaaaaatatcattcagtcgctgtcggaaccggagaatgcggcgatggtcagcatatttgtgccgggagagctggtgatggcggcagggctgacgccgtactcagtggaggcgatgtcctgttttatggcgggaacaaagtgtgagcagacgtttcttcggaaaacggaggaagaaggatttccggagacgatgtgttcgtaccacagggtgtttctgggggcggcgctgacggggattctgccaaaaccgaactgcatgatttatacgaaccttgcgtgtgatggaaatatgatgacgtttccgtatttaaaggataaatttgaatgtccaggcttttatattgatgttccgtatgagaaaaaccgggaatcggttctgtatgtggcggatcagctacggaaattaaaacggtttctggaggagacgacggacagacggatttcggaggaaacagtgcggagtgcggtagataacagccgaaaagcggcagcgaattataaaaaacagcttgccctgcggtgtgcgcatgacccggtgacctctctgacgaatgaattgtatgcgctttttatgtgccatctgatggctggctcagagacggcggttacctatacggaaaaacttctgcgcgatgtgcggatgtcaccgaggggagatggtctttcggtaatctggatgcacatcatgccatttttacaggagccggttaaggatatttttaattatagtaagaaaatgcacatccgcgcttgtgatttcatcgcagatggttttcaggagatgcatgcggaagacccgtatgaggcgatggcagagaaaatggtctactgcatttacaatggcagtgtgaaacagagaattgaggaagcggaacggcttgccagaatcacggaatcggatggtgctgttttatttgcccactggggctgtaagggaacgatcggtgcatccagcctgattaagcagtccttagaaaagacaggccttccgacgatgattctcgacggtgacggctgcaaccccgccaataccagcgacggtcaggtatcgacgcggcttcaggcgtttgtggaaatgctggaaaagggcaaggaggagaaacacgcatgatttattacgtctgtaagtacaccccgatcgagctgttccgggggtttggagaagaatgttctgttttggaggaaatgccggaaaatttcgaacagtcggatcaaattgcacatgcaaatctgtgcggctttggaaaatcggtcattcaggcagtgctggaaggaaaggttgaacagctggtgctggtaaactgctgcgattcgatgcggcgcgtttacgatatcgtggagagcacgggaaaatgtaagtttttatatatgctggatctgccgcatgatgataatgaatgtgaaaaagtgaaatttgcgggcacgatccggaggcttaaaaaggcatatgaggcatattccgggaaagtgtttgataaacgcgcttttatcaagtcctttattacgccggaaatgaacacggagccgtacattggtgtgctgggcgtgcgggtcagcggcattctggaggatatgatccgggacaatatccagatggatgtggaaaatctgacctgtacgggtggtcggaaactgtcggtcgtacaggatgaaatgtggaatatggaggaagaggagctgtttctttcttacgcggacgtcctgctgggacagatgccgtgtttccgcatgaaccgttcgatccgcagaaaccgtctgtatctggatccgaatttaaagggaattatttatcacacgatcaagttctgtgattattatggatttgagtatgcgagtatcaagcgggatatcaaggttccgctccttaagattgagactgattttacgagccagagcgcggggcagcttttgacgcgcattcaggcatttgaggagacgatcgagggatcagaggatatggatccgggaaaaggtatcagtgaggaggcaagaaagaagatggagtcaggcattttttatgtagcgggaatcgacagcggttcgacaagtactgatgtggtcatactggatcaggatggaaaaattaaatcgacgatgattattccgaccggcggcggtgcgatgatgagcgccgagaagagtttggatctggcgattgagaaagcgggaattaagaaagaggagatcgtgcggatcaatacgaccggatatggacgatcctacattgacagcggggatgacagcatcacggagattacctgccatgccaagggcgcaaattatctgaatccgaatgtccgcactatcatcgacattggcgggcaggatatcaaggcgatcagcatcgacgggcagggagccgtgaaaaatttcctgatgaatgacaaatgtgccgccggaacgggacgttttctggaaatgatggcgaaaacgctgggactttccctggaggaaatgagtgtgaaagggctggaatggaagcataatgtcgtgatttccagcatgtgtacggtgtttgcagagtcggaggtcgtgtcgctggtggcacagaataaggatgtggcagatattatccacggtttaaatgtgtcagttgcctcaaaagtcggcgcgttggcagcccgccttggaaaggatcatccaggcgaatatatgatgaccggcggtgtggcgaagaaccggggtatcatccaggcattggaagagaagcttggtgctaaactttacatctgtgatgaggcgcagctctgcggtgcgctgggagcggcgctatttgcttatgagaaatgtaaaggcagtgcggaggaaacgcgatgaagcgacagggttaaaacacttgtatcgatattttcgtcagatattcactgggagaggctgtggccaattcgtcgatcacagcctctttataagagtatttgccggttttaaacttgtgttcatcggtccaatcaaagagtttttcgtaggtgactttcgagtcatagtaatttcccattaagtaagcaagtaccttgccagcccaaagtgctacaacagtcgccctcaacagcatatccaatatgcgcaaagaagaagtattgcaatatagaactacaaccttcctcttccatatttttttaatatctgacacatttttacggattgcattttttacacggatcataacctgcagcaatcagcgcatcactactctctgatgaggattttttattgctctccttcatctgtttgaccgatgaacaggacggccgatgaaatttctttgtattggtattgaggatataggattccgtgctggtctgctgagaagctacctgcgtaacagcctgtgtggcctgctctgttactgccttcaaaaaccggagtcacccgatacagcacatgatttccagtttcttttacatagtccgctgccatattctcaaacggcagcattccctgaacattcagatatctggtcccagtgattaagttcttctcgtttgcattttctgcagtaagctgataaccgatcaaatggcagcgattatataaatatttgccatccacattgtcatatttgatcgtatgccaaccagatggctttctctgacatttctttatcctcttttctttgaaatatgaaagaaaaattatcccttcatataacgaaacgctcagagcatgttttacagtggtcaaaagcaaatttttttactttttttcttacgagttttcttgcgtgttttttaaataccactcgtaagaaactcgtaacattagatttttcagtaaagaaaaagagcatatggaattgaatccatacactctatgattactgaaactttatttcatttttaattcaacaaacttttgtttatctcgttcttaacttcatctttattctcgtatgttctcactatcggaatcgtactctgtctgttctacataatctgcggaacagtctcgtttgtacggataaaaaattcaagtcgagcatccgcgagacttggcgcgtgattctgggcagcgtaagctgacatattctttacagaatcactgcgcatcctcgcggagcgtttatctcagtcgagaagactcccactgagacaaatttgctgttactcaccacctgaaagaggtgggagtcttctcgactgagataaactgagccacggctgttccaacatgaaatcagccgtggccttatttatatcatttcactcttttttgaaatagaacaacaccacagcaacaactcaaatcgttttaaaattccagactattcgcattcagcaagaaatacttcattcccatgatgacaaaaccttcatcatttctccaaggctttttgctgccatttacaatgacgatcttcttgaaagagtccgggatattacgcagagaattgaactcctgcgtctgtttttcttccgaagtcatgtcatatgcaacctggatatagtatctctggtttccttgattcaccacaaagtcaacctccaactgcttgcgaacacgtttgccctctttatccttatcgaagatatccacgacacccacatcaacattgtagccacggatcagcaactcgttataaacaatgttctccatgatatgagtaggctcctgctgtctgaaattcagacgtgcatttctcagtcccagatcagtaaagtagtatttcagatttgcaccgatatactttctgcccttaatatcgtatcggcttgccttggaaatcaaaaaggcatctgtcaaatggtcgatatgcttggagatggttttattagcataagtcatctggcgctcactggcaaatgtattggcaatctttgaagggttagtcggtgcgccgattgcagatgcaagcacatcaaccagaatcccaatctcatccacgttctgaatcttatttctttcaataacatccttcagatagacatttgcaaagatgttcttcagatagtccgctttctgtcgttcgctctggaaacttacgatctgcggcaatcctccgtagatcatgtagtcatcccaggcatcatcataatcgccgtcatagacagaataaaactctgcaaaggagagaggatagattctaatctcatcacctctgccacggaattcggtcacaatgtcgctggaaaggaacttggaattacttccggtgacatacacatcaatattgctcatgcggagcaggctgttcagcacttcctcaaatcgtggcatgaactgcacttcatccaaaaggagataatacttcccgtcgtctttcatggcatccttgatgtacttgaagcataccttgggatctcttaattcctcgttctcaataccatccaatgcaatttcaataatatgatcaacatcaacgccgttctccagtaagtatctcttaaagatggtaaacagcaaaaaggatttgccacatctacgaatgccggtaatcacctttatcattccattatcttttcgctcgatcagctgctgtaggtaagcgtctcttttaatctccatcgttacactccccatttccgtgcatttacacactttttagtaatgaaattctatcacagaacgacctgaatttcaatatgtattcccattttatgtgcatctacacacttttatgtaatgttgataaatatattttcagatttttttgattgcagtgtctataatcgattactccaatcgttattataggtaaacaacaaaaagaagatggttccgatgtttcattaaatatgttcgttagtcttttacgcaaaggattttatctcctctgcgccctaatgcttttcggattcagttcaacaaacttgaatttgacttgcctattttcttaaaatctcatgtggagcttctatttcatttgccaaggtatgctctgttaattctgacatcaatttcaattttttattaatcaatggtcgcatacaattaggaacatgttcctgatgcgctctgtggattgctacacattccttacagtttccgtgataacgacaggctttcaggcaaggacagtgatctttgtctttatactccttacgaaattccgctgcaaattcttcttgcagtctcagcccctcgacacggtttcccttatgaaattctaccattgcatccagttctttctggttcccttcaatcttcatgttattatagcgcctccatttcaactattcctcattttctgataaattcccatacaaactggaatttggtgtgtgctttataaattttttccgatccactcaagttcgttcatggaatccttatttttttcaagttcatctctggctgttgcgtaatatgattttttgaaaagcatatcccatgaaagatattttgccatacagtcaaactgcttatcaatcagctcatactggatactgtctacgggagaaccacctacaacaattgtgccaacttttttgttttttaactgcaatccacggcagtagcacttatcaatgataagtttcaattgtgctgacattccccaccaataaactggtgtagcaaaaagaatcatatctgcggcagcaattttatcaattgtagaatttgtatcatccttatcgacgcatcccttagagcattgacagacaccacatcccttgcatggtgcaatgttgagtttgtcgggttcaatgatttcaattttattcttttctgacgctccttttataaatgcattgattgctgccagcgtatttccttttctggcacttccattaatgattacaattttcatgcgtgtatcctccaacttccgatttgcacatcaaatcgttttcttcattctatcacaacttctattaatccgccatcagtctttcgaaccgggtatccatgacaatgataaactggcctgctcctggcaattcttgcagcatttcatcaagagttttctgtttcacatatttctgcacatacacccaacaggcaacgctactggcttctgatacaatgtcagctatagttttgcgcataagctcttcaaattcagcaatttcttcttttggaacaacatcatacagggttggtgcctgattcgttctctgtgaagattggaatctaccatacttaaaatggaatcatcttcacttaatactcggatgatcaccggtactttacggtatcctagtttctccgcagcatgttttcttctgtggccggatatgatctcatagtagccatccggtactggtctgacgatcagcggatttaatatgccatacttctcaataatttcctacagaagaaacatttccttatcatcttttacttgaaatggatgttccttaaaatggtggagacgttcaatctcaatttctatgattccttcttcgttttctcctgattgtctgtttggctcagtcatcttgactcctttcctccaggattcaggatactaaaaaatgcctgcctggaacttttatagatagtaaagttccaaacagacattgctgtttgaccattagctgcagctaatagaattaaatactgtttcagctaatttatgtttgcaggtttgggagagattgtttcttttcccgccttttctctgatttacatccccgaataaggggtgacaacagagcagaacccaaatgttagctgaacttcctaaagcccatgtttgcaaacaggtgattttgattagctgtcagctaacaaaaatcggattgcgttagctggaaattgatcattttgaatggaattttgtgtcacgaacgtgattagaaaataacaaaagcgttcgctgtcagctaatccagctaacattttcgaacgctttgaagcccgtcgccaagaggatttgaacctccgacccctcgcttaggagttcatcctggtacagaaaacagcttgcattctatgtcaatcaaagtcattcaaagccttgattttactgctttttctgtcaatttcagaaaagataagaaaacctgttttcatctgaggaattacagtttgggtggaaaaatggtggattttccaccattagggtaaagccaacctgttccttccaattataaatgatgactaccattacctgacattttacagtaatgattatttggttttcttattagatctatgtctattataccgtgcttgcggtcaactgtcgataacaaattgaccgcaaatgtattattttttcttacgtttacactttgtatcacaaaacttctacacttcaaatactcggaagtgtttctgagcagattcatatttccctgtttcgtaatttagtattttccataccggatttaattgctcgtccgttaacggagtaacctgattgtctttatccagccatgcaaaaattatctgttctgattctatccaggttaagtttttatccttctttatctcatcaatattctcctaaatatttttctagtcattgcaatataaaattgcttatacagtctctcccttaagagtcctggtattctggataatatacagagcgaccgatatgaccatcattatagcgcacaaaccaatcaacagatctgataccatcggtgtaatgtggaaccatataatatgcaccgctgcagttccatataataaaaaggttactatctttccatgccagtctgcaccatgtacttttcctgtcttttgtatcacaagacatccactgactatcatatacagctccttacctgccattattacgattaaaagaagcacatgcggaaaacgagtaaacagacagattaacatcgctgcctgtgtcagcttatcagccaccggatcaagtatttttcctaaattactaattctatggaatcttcttgcgatatatccatcagcaagatccgtaagaccagacagcaataagatttcaccagctaacagaggatttttctttacacaataactccatataattaccggaatcagacaaagccgaaaaaaagaaagaagattaggaaccgtaataattctattcaaattttcttcctgattcacttcactctgcatgtacggtcacctcactttccttttttttagacataaaccaataaaatataacacaaaatgctaaagcaaacacaacaccaaaaacattttgaatcactctaagactaaccgctccttgtagtccataagtctctgcagcaatggctaaagcaccaaatgtgttaaatactgcctgccagccatattgtgctgaaaatcctacaccgattccaccaagaattcctatatatgcatagattgacgaaggaagcagaaaatataatactgtaaaacatataacacctgcaatatttccgacaatccttttacggactctgtagtgcatatcttccataaacggcaaaatcgcggacatggccgcaataccagcccacattgcacgtggcatattacaaagttctgcaatgcaaaggacaatcggtacgcataaaatctgacatatctgccattttgttctggaagaagtgatatcaaattcttgtatcagatctttcagatttcttttataagttctgtttttatgatttcgataaaatacaaagcaggtaagtgctgcacctaaagccattccgactaatcgcatctgatagctttttcccgtaacatcataaccatatagcagcagatacccaagaaccaatgtagattgattaaacatgaatggattatggcatccgaacagaatcaacacagccagtgccgcaatatttaacagcattcccaatactggtgaaaactgatttgctaaatgcggacatacagtcataattacaaagaacaaagccaaaagcatcgtagattgtccggtgtggatccccagatccgcattccgaaataccataaggcataataaaactactacacccacaatactattctcatttccaaataagatactgaaaatagtaacaaataaaaaacaaaatgccattgtaacagctatctttaccaaatataccagtatatgatatgatttttctttcactgtttcactctttttcaacagatttttagaacctgcctgatttaactgcaattcctgataaaatgtcatgtaattcctcctctatctgtttttcttaaacttatatggcctcatctttctgtattggaagctctacaacaaatctgcatccaccatattcccggttttctgccttgattgtcccgccagcactatctacgatccgtttcacaagtgcaaggccgagaccatttccttctgctttgtgagaaccgtctgcctgataaaatttatcaaatattctggttttcacatcatcctctattcccggtccttcatcttccagaataaacattacagaatccttttcctgcttcagaaacatcataattgtcccctttgcaggactgaacttaatcgcattatctaaaagattcatccatatatgcataaaaagtccttcattcccagtatatttaacttcctccagctctacctggaaaccaatttctttttctgtccattttgtttccaatgaaagaaatgcctggcggatctgttcatccagacgatattctgtttttttcattggtatattctgattctctaacttggataacagcaaaatattaccaaccaatccggaaagtctttgggtgttaaataagattttttctacatattcctcttgatccggagacagttcttctccctgaagcagcattgtatatccttcaatggcattaatcggggtcttaaactcatgagaaacattagatacaaaatccatctgcagcacctctgttgcacgaagttcttttgtcataacgttaaaactttgataagattctccaacttctgctatacggctgttcgtttccaaatgctgttcaaaatctccctgagaaacttccttcattgctttactaagtctggtaattggttccagtaactttgcattgataaaggaagtgatcagccctgcaatcaatgtattgaaaatcaaaagccagccaagcacaggtatgccgcccggcagattaaaaaaatgattcaaaaaagcaaataataaagcagataggactgttgaaaatacaagtgccagccagattgcaccagtcagacaggatcggatccgcaatcctttttttttcttttgttccattatctttttaccaccttgtatccaattccacgcattgttacgatttcaaaatccgggttatctttaaaacgctctctgattcttcctatatgtacctctattgtatgtgggtctacctccgtctcgtatccccatacttcatccatcaactgttgttttgtaaatgttctgcctggcgaagctgcaagcttatataaaagcaggaattcttttttaggcaaaacaagactttccttatcagttgtaaccgtcattgcatcataatcaaactctgttgaaccgatcacaattttgtgttcattcagtatctgtgcacggcgaagcagtgctccgactcttaaaaccatttcattcacatttaccggttttaccatataatcgtcacttcccgaaagaaatccctggcgcatatcatcaaaggaacctttcgcagtgatcataagcactggtatctgatatcctgctgaacgaagttctgacaccagttcatagccatccataaccggcatcataatatcagaaatgatcagatcaatatattccttatccaatacttctaatgcctgtgctccatccgatgcatttttgacttgatatccattcttctcaagcactttttggaatagctggcttaattctttatcatcttctacaatcaatatttgaaacacgttttccttcctccttattaaaacagataccttgcccatccaagcagatgctgtaccaaaaatatttttctctgacgtttctttgttaattcaattggctctacatgatatggatcattataagttccgccttctaatatctggcgggacactttttcatattccatcatgccctcttccaactgtttattaatatctttactgcgaattacaagcatcagttccgtatccagatacgtgcttctcatatccatgttaaaggaaccgattacggatagatcatcatcaatcaggatgctttttccgtggtaagaatagccgccttcatactcccagatatcaattcctgtatttaaaattctgtttctgtttctcgcataatcagcagaaccaaacggatttccattgttggcaaccgaattggtcatgatagaaaaatccggaactctctccgcaatctctttccatgtattatacatcatatcattgcagataatatatggtgtatgaattttcacgcgctcttttgcatttttcattagttctcccagttgataccagactactggttccttgggatctgtgtgaataggatttgacactaatgtaatcttttctgtctcaaaagtttcgtccgtataatcggtctcgcagattctttccttattctcttcaaaatatttctgatagccgttctgcagctctaaaactgcgttctttacagattttctatttgccagttttttattgttatgaaaataaccactgtcttcctgattccatatggtttcaaaatactctgacaactgattaactgaattttccttctcaggttcatcgcaaaccactaacacgtctctgtcatagttcttatgtcccggaaaatcacccaggaaataattgtatgtatttcttcccccaagaatatatctctttccatctgcaatcaaatatttatcatgcattctacccatcattttccacggtttcaacggattggccttattatacagtttaatttcaacattctcatgggaagataatccatagaaatacggatttccttccatatcaatccagctctccattccatctactaacagacgaatatgtacacctctgtctgccgcatcatgcagtgctcctaaaatcaattttccactttcatcggattgaaatgcaaaagtagaaagaataatgtcttcttttgcatttcggatcaaacgcactctttgtaaaagtgcttctggatttttttctatgatcactgctcgttccatattctcactgcattcgttccatgacccattttttgtttcttttttggttgtattggacacttccggctgctttttatatgcaacgcagattccgagcaattcataaaaagccacacataaaaaaattgccagtataacaagaaggattttacatattttatgctttttcattgtacatcaccggattcctttttatttcatacttatacaatacaaagtcaatctcaatttaacctcaacaaggtttgtttttttcatccatgcaaaatcttctttgtacaacagactgttagatatagcaaaaacggcctttcaaaaacagttaacttctaaatcaactgttttttgaaaggtcgtttcatcagattcttatagcaatccagcaaataatctcataaataattgtcccagtcgcaaatatgcacttcgtccggtttgatattggtctgtcacatcacgacattcttccatcgttcttatcaaatcattttttatttccacaactgcctgacaatctgccataaaacagccgttttcaaaatggtgatataaacttcgataatccagattaattgttccacaagttgccatacagtcatctgccacactcatttttgcatgacagaaaccaggagtccactcataaacacgaacaccatgtttaactaatccatgataaaaagaacgagttatattataaatgaattttttatcagggataccaggtgtgataattcttacgtctacccctcgcttagcagccagacataacgcatgcgtcatttcatctgttatgattagatatggagtcataaaccaacaatatttttcagctttatttatcatactgatataaacttcttctcctacttgctcattatccatagggctgtctgcataaggttgaacaaacccagtttgctgtgccgcataatcatagtggaaaaggtatttactaaaatcagaatcattagcatccttatcacttactgcattccacatttccaagaatgtcaccgtaagcgactgaacagcatctccttctaaacgaatacctgtatctttccactgtccatacgggtgtgtgtaattaaaatattcgtttgctagattatatccacctgtaaatccgacttttccatcaataactgttatttttctatgatcacgattgttcaaaaacagatttaaacctggcataaacggattgaatacacggcaatgaattcctattgcctccatctttttcacaaaatctgtgttaataaagcctatagaacccatatcatcgtagaatactctaacttccacacctgcttttactcgctcttccagaacatcttgaatcttatgccatgcttcagcgtcttctatcgcatgatattccataaagataaacttctgtgctttctccaaatccttaagctgtgcctctaatcctttcactgcttcatcaaaatacacaatatccgtattctgatagattggatactgcgaatttctttgtatgtaacttgctatatttcctgctttcggaattgtttcttttattttgctcaaacacgcctgactgtctggaagcattggtaacaatttgctatcaatttctgcatatctctcacgcattttatgtgtgccaccattcaaaccaatcaacaaatacaggcctacacccataattgggaagattagaattaagatgacccaaggcattttcatagaagaggtcttatctgatgcgtacaatcccaaaaccaagattccactcaaaatccttgtaaataaatttataatttctgcatattcattcaagcgtgttacgatagtaataataaaaattacttccagaagaatgcagactatggaaaaacacagccgttttaccccattttttgtttttgctttgccctctaaagtatcttgcttcatatatattccaccttcctacttgctcagttttctgcctaaatttcatgaaacataccaattttgtcttttattctctgcatttcatcatccgcttcaatgatagctcttgcagaatgaagtaattcttcacttatctcatcataaccaggcatttcttcaattccttttttatagcgaagttgatgttccaatgttgcccagaaatccataccattggttcggatctgtaattctacacgcataggtgttttacccttagcaaaaaatactggtatttcaacaatcatatgatagcttcgataaccatttggttttggattttttatataatcttttatttcaataactttaatatcatcctgttgggtaatcaaatctgatatcatataaatatcgtcaataaacgcacaaactattcgaacgcctgctacatcatttaaatatgtctgtatattttctgttgtaaaatcatgtcccattttctgcaatttattgtaaatactattgggcttcttaatccttgtttttataaaagaaataggatttcgattgttctcaactgaaaattcatcatccaaaacctcaagtttagtttgtatctcccgaatagcacaacgatacatcatcattaaattataaaattttgtagcattatttaaaaactgtagtgattccggactgttcatcctgagtttttttacttcatcttttgtcatggaactttcctttctacctcatccctgatttcaaaacattatttattttgatagttgattcgttctccttgaattactggataacaaatcattttatcactatccagattttctacatgcatatctactgcactgatctgatggttttcataagtattgtaataataaataccttttgtaacattacaacacgacgtatacaatgtgatttcatattttccatccgttacttcgcaacatcctcgttgctgatccacagatccgagaatgtggaagaattggctaacgctttcttcctctgattcacctgaaattgcatttacctttgtaaaagctacacgtacaaagcgtgaggaagatgagagatctcccggaagacctaatcctcccatacctctactatatgcatcaagagccaaattttcgcagaaagtatttctgggctgtttaggagataaatacatataattatttagttgaaacatctgctgtggaaatggcggattattcgtaagcactcctactggattgtcataaatatgcaaaccatctgacatagattctaccgtaattgactcattctcatcagaaatgatccagtgtaattgtgctaatggcaattgctcgctgaaaggagtattaacaatattaattcgttcaagaagctcgcgaacttcaactaaagaagaacactgacttaaaatccacggaataaattcaaactgtgcaatattttccacatctggcttaatcgttgcataaacagcatttcctacaaaattcagtcctgccattgccactcctttttcattcatagcatcataatacaaaggataatcctctgcaacatgagccattccaataattgcataatgatttttcatatcgccaacatggcgaaaattaaacgcataattacgtggtgtaattactatctgatcaccataagagaattcataatcgagggttcgtccaaagtaaaaatcttttgttttataagttgctgctgtacacatgatcgtttatcctcctaaacagattgaaatatgtcaatgagttttttcttgaacaatagtatagcacaatcttttattttgttccaacttcatacatgatcataacatgtaaactttaaactattttcctagattatttctccatcagtttttcaaaccaggtatccatagctaggatgaattgacctacgtctggcaattcttgcagcatttcgtttagggttttgtgcttcacatatttctgcacatacacccaacaggcaacgctactggcttctgatacaatgtcagctatggttttgcgcataagctcttcaaattcagcaatttcttcttttgggacaacatcatacagtgttggtgcctgatgacttatttttactccattttcatttgcatctttaagcagattcttaactttttctcttgaatcctccggtactttcatgtactcccacataaatgctaccacatcggctggtgtgtcttttttaagtggcggtagctgaatataatcattgtttttgctcattttcatattctcctcacgatataataaaatcaataatacgttctcttgtcatgtccaggacagtatccacaagcactcctgcaaacaggatcagatacagaattgcactcagcacaaacaggaatgcaacctgtacccagtcatggtaacagtatgcagtcgctataatcaacaaagtgaatgtaaacccaaggattcctctgacaaccgcataagtctgtactgtcatcttcactgccaggccaatcacaaaaaggatcagccataccggcagtaataatatcttcccagcaagttttaaaataaacatgtgcacctcctatcttaccagtcctggcatatcatggttcacctctgcctgataatacccgttcatcgttgacggtgcattaaacaaagctgctaataaatatttcttgatgttcttcacctttgtggtgttaccactcatacagtgtaagacatactcgatatgtgaataggtcagcatcagaaattttttcttcaccagtgatgccggataccagttgctggcaatcaagatcttgtcatttttacacatcacagtttctacgatcaggttcacgatttcatcaacctgtcgcatatcgtcatgatgggttacttccagtgactcataatcaacggtctctttgacaaggttttcataagcctgataatcctcagaacgattatcgctatcaaatcttttctcatccacagatatgatatgattagatttattatcattcatttcagtatcactaagattagtattattagggtttgaaatgtaaacttcttgaagtttgttttcgggacttcatgaagtttgaattgtaaacttctgcgggttcctcattttccacagaagtttgttttttaaacttctttaattcctcttcaaattttttctcatctgttttctcaggcataaaggttttcacgtagatgacgttcacctttccaaatccctgtctgcgtttctcaatcaggccaatccctgtttcgtcatccagttctctcatggatttgatggctttatttctgccacagttcagtaattccatgatatcttcgatggaaaagtagatatatgctctgtttttgtcgtcaaaccactgattcttgatggaaagagacattcgatccaacatcagtccatataaaattttagcatcgcttgataagtctttaaagtaactgtctgtaaataatgcttttggtatgcggtagaagctgaactgatcagcttcggtaccgtaaaaataattaaatgtcatttttttctccataactgcctcctttcgttttctgctaagaagtcctctttttaaacttctttgactttgttttcttaactttttctatccttaacaggactgttcatgcatccatttttctaataatgattcaatcacctgctccatatctttgtctgtataatcatccggaaagtactttgtcagtttcttttctgagaaagtgagagaccgggatactttctttgccatcacacagttattgaaaattgataacatctgaatctgattgattggcccatcattcagttgatttctaagtgttgcaatctgtttgggcttgataaatccagtgtcgctgatatattcgtaaatccattcctgtacttccttatcgatataggagatatcaacagcaaccgtgaactgaagctttttgttatctaccagatcaagcagttccggaattaactctgtcaggcggataaatctttttacctgatgaccacttattccctccgtttcaccaattatatctgtggttaaattcgggacaatttgtcccgtatttcctttactgggtctaccagcttttcttttcattgcctcaagtttcatcttataagcaaaggctttctcactcggcaacaattcctctcgctgaatgttagcgtccaccatagccacaatggcatcatcatctgataattctcttacgattgccggaattgtcgtcagtcctgcaagctgtgctgcatgcattcttctgtgaccggataccatttcatattcttcattttcatccatgcgaagcagtaccggtgtcagcacaccattgatctttacactttcaaccaggtcctgcatcttttcatcatccagcaccttgaagggatgatttttaaacggatggatcttactgatctctatctccattgctgactcttcatttaccacaccaagcagttcatcaatacttgccagtttaatcttttcgccacttctatttttcattcttcaaaacctcctgtgttaagttcatatatgcttctgcaacctttcctttcgggcagtgcatgtagatgctttttccctctgcactggtctcagcagcttttacagacatcggaattacattttcaaatacctcgatctgacttccgtaggttgtatgtactcttgatgcaatgtcccttgcgtaattggttctgaagtcaaccatagtcaacagaatgccttcaatcgccagtttccggttcagtcttttctttactgtaagaatggtcttgatcagctgctgaagtcctttcaccggcagatatgcggcttgcacaggtatcagcacggaatcggaagagaccagtgcattgattgtcatcataccaaggctcggcatacagtcaatcaggatataatcgtatcggcatcttatcgcatcgatatattctttcatgatcatttctctgctcataacatttcccatcgttacttccagtgcggaaagctcaatatttgccgggagaagatctacattttcctggtgatgtaagatcccatcttccaaagagatttcttcttcgttgatgacatccatcatgatcgttgccagtgtgatgcgaagatcatccggttcctcatatccaagacttgcggttaaacttccctgtggatccgcgtcgatcagcaacactttcttaccttctcttgccagtccaatgcctacatttacggttgtggtggtctttccgacgccacctttctggtttactacggatataactttacacatgattgcttcctcctttaactttcccatgattcttttttccataattttagtagtgtcaatatttcccgtttcatcattgccggtgtataggaattcggaaaatacttatgtagctgttcgtttgtgaaagccactcttgtgatttcaccctttttaacctcacacatgatttcttccatcttttccagtgacaactgcttttctttactcagttgccggatcctctgggcctgtgagagtgacgggattgcctgtgcatactccattgctacaagcagttccttttgctctttttcacttaatgcagctatctctacagccggacaaaaagaaataatctcatcatccagtttctgcagcatttccggtatcagttttgtcagtgagatataacgctgcacttgttttgggctatcaccacaatcctcgctgataatctctatcgcccgctttcttggtgttttgtggtcaacttggctcttttttcgaccactttttctttttaatacgtcattcttcaatttgtaagcaaaagctttttcactgtagctgatccgttctctgtgaagattagaatctaccatgcttaaaatggaatcatcttcacttaatacccggataatcaccggcacttttcggtatcccagtttctccgcagcatgttttcttctgtggccggatatgatctcatagtagccatccggtactggtctgacgatcagcggatttaaaatgccatacttctcaatgctttcctgcagaagaaacatttccttatcatctttcacttgaaacggatgctctttgaatggacgaagacgctcaatctcaatttctatgattctttcttcgctttctcctgattgtctgtttggctcagtcatcttgactcctttcctccaggattcaggaaataaaaaatgcctgcctggaacttttatagatagtaaagttccaaacagacattgctgtttgaccattagctgtagctaatagaattgaatactgtttcagctaattcatgtttgcaggtttgggagagattgtttcttttcccgccttttctctgatttacatccccgaataaggggtgacaacggagcggaacccaaatgttagctggacttcttaaaacccatgtttgcaaaccggtaattttgattagctgtcagctaacaaaaatcggattgcgttagctggaaattgatcattttgaatggaattttgtgtcacgaacgtgatttgaaaataacaaaagcgttcgttgtcagctaatccagctaacattttcgaacgctttgaagcccgtcgccaagaggatttgaacctccgacccctcgcttaggaggcgagtgctctatccagctgagctatgacgacacatgccgcaaacccttgattttactgggtttctgggatttttcccttcggccatatataagattatcaactcttttttgagctgtcaatctacagattttttttgctaatgaagcataataattgacacatataaatgattttatactaaccaattcaaaaagtcaaccctggcatggctttttgaacgcagataagcaagtagcaaagcggattgcgaatgtccgctttaccgctttacccttgtcagaacaatggggataaaataaaaaggacatcctatctattgaattttttattttaagatagaacgtcctttttaagttttgctaaaggaagcttttgattaattatttacctgtattatttgctttttttcttcagcagttttgttcctgttaaagttgtgcatgagacagctaagagtgcaatccaaatcataacgtttgtatcatctcctgtttttggagaagtagtggcagaagtacttgttccggttgtggaagttttgcctgtagaggctgttgtttttccattggttgaagtatttgttgtactgcctgttgttttggtggtaccgttcgttttgtctgtagtgctgttatttgcattgttgctgttgtttttattatcgttaccgttattggtattatcgttcttgttgtcgttatcgccgttgttgatattatcgttcttgttgtcgtcatcaccatcatttttattgtcgtcatttttattgtcatcattctttttgtctgtaatagtgaaaacaatttcggcagaggaaccagcgtagttgccgatacctgtaacagttaacctgtagcttccagcgttgataaattctgtatcagcaaaattttttgcttcagaatcatctccgtagatgcaggaaacagtgtaatcaacaccttctgttaaaacagtttttccatcttttacagtcagagtcggtgttttagctgttccatcataagaagcagaatcggaatctaaagcaacatcaaaagtaagttcttttggcgtaatcgtaaatgttttttctacggttccgtagtaatttccaataccggtaactactacagtgtaagtgtctgtgtttgtaaatttaccatcggattctgttccatcttcgtttttgtaagtaatgaaataatccgttccttctgttaaaacagtttctccatcctgtaccattacagaaggggtaagttcttcaccggtataagtctgattttcaatgtctgctacagtgaaggtatttgttacagcatttgttatgaacttatctaatggaggtgtagtttcaacacctgtagtccagtataattcttcaagtgggtcattattgacatcattaccaatctgtgtaccattttcaatatgacggcttgcacttgtaacttttacatttccggaaatggcatttcccggtgttgcgtttttggaagtacgagaggtagctccctgaaggaaagcttcggaagttgtaatcattccgtttccaatgactgcatttccgccgttgccccagagtacgtcgccaccgatagcaataacttttccatttcctgtgatgttaccgttgtctaattcaatagcagaaccgccttctgcatagagaagtacgtttccaccaccaccataagtaacgagtacggcattatcttcaagatttacagttccgtcttttacgagaagggcagtctgtccaaggtcacttcctgcttcatccccggcaataaatacctgtccttttacagttacatttccatttgctacaacaactgcttcagaactgctgcggtctgttaagtcgccgtttgcaagatagttaatgtgagagtaaatagatgcattttcaaggatagcaccatcctgcaggcgaagctgtccacaaagagaagcgcctgtagtaaattcttgattgtaagaatcatagttcatagagaatgtaccgccgttctgtacgtcgatgattccctgaacaacagaatcggaaagagtcagcttaccgccggattctactacgatgcggacactgctgaggatttccatatttgtcatagtcagattgcatccagccggaatgtaaagggtctgtggaatgtctccggcttttacctgtttccatggaaggtcgtatccaagataaccataagtaccactttgatgggaaccaaaccatgcttctaaatcttttggaacacgaacgctgttttcttcgccttctacattgcttccgaagtttttgattgcccatggttccatgatatcccatgcataaagaccatttccatactgttttaaattgtcggtagtcagacggtctgctaaagtttcttcgcctgtgtaaacattaaatggtaaggagttgctgacagcggttcttccctgggtatctgttatagatacggaaataagataagcaccggcatcttttggagtaccgtttaatgtcaagtcactgctgatggtcatgtaaactccgctcatgccactgtcgctgtcggtaggagttcctttttctgtattcggaacaatgctgacactgcatttgcttccgtttaggttgatttttgaagaatggtcaagttcttcccagtctgcgtctgttggttcagtcccttttgctgtgatggcaccgtaaacttttgcagaactgtttttgctgctggtagcgccaccaacacttgcgcttgatacgctgtcatagttctgctgaccaatgatggctgattcaaaagagccttccagttttacgtgaagttcataagggtcgccctgtccgtcatcagcaactaaagaggcatttccatttgtatcaattacaaatttgaaagtcagttcctgatatccatcagcagtaagtgtgataacatcaccgctttttaaaacagggatttcaggatttgtactgaaatcttttgcggagaaaaccaaaacattattatcggtatctttatagtatttaccaccggcagatggtttaaaagaagagttttcccaggattctccatttacttttacgtcggtaacggatgtagcatagttatctgcattttggaaagaaagattccagtttgttccgaagaaatcagttgcaatgcttaactggttcagttcgatttttaccggttcagcaggttttatttttttaaaagaagctgatacagttacatcttcttccggcatgataaaagtataaacaccgtctgtattctgaagggcaacttcagttccggttgttatacctgtaactttaatggtatcaagttcatagttttcagctggtgcaggtgttacggtaacagtagtgccttttttgatttcttttgttgcgctaagctgtacatttccgttttcggtttcggctgcagtagcagaataggttttttcagcaggtgctacaacagttgcagtataaacataaggataagaagaagtattttttgttacctgaaggtttaaatcctgatatccgtccgcagaaattttaatagctgcaggataagtagaaggatttacgattttcagggctgtgtagcttccgtaagcaccggtcacacttccgacttcccagaggtttccgtttgacccccagctgttaatggttccctttgtataagtcgtatcatttacaacgacattattaattgcattcatccagcccatatcttcaaagccaagcgttaagatttcggtcataaatccggtgacagagcattcggtcactgcggttggtgctgctttatctcctgccgctaaaacaggtgagtatgtcgtagacagacaaatcagtaaagataagagcagggacgcaatttttttccatatttttttcatatctctctccttgtaaatatttgatttttctaatgttagaatggctgctaatacgattaaagatagtccccctttcactataataattagcacatctgataaaacaaaagttagtatattctaacaatggtaatacaatgctaccaacaattaccaatggtgtcaatgaaaaaaaacttattgaaaaaaattatctgtaagacacaaaaatgcgatagaaagtatacggaaatcttttatcaaacctataaaaatggtataatgtacccaataaatcaaggaggtgattgaattgaagaaagtagttttaatccccgattcatttaaaggaacattatcttctgcgcagatttgtgacattatggagcagaatgtgaagaaacactttccggagtgtgaggttgttaaaattccggttgctgatggaggagagggcagtgtaaactgttttctgactgctgcaggtggagaaaagagaaaggttatcgttaagaatccttacatggaggatatggaagcattttatgggattttgccggataagacagcggtgattgagatggcagcatgtgcaggacttccgcttgtggagaatcgtcaaaatccagaagtgacaacgacgtatggtgtcggtcagctgatgcttgatgctgtggagcatggttgtaagaagatagtagttgggcttggcggttcgtgtacaaatgatgctggtgcaggagcggcggcggcagttggagttgaattttttgataaagatggagagaaattgattccgacaggcggaacacttggaaaagttgcaaaaatttcgatggaaaatatggatgagcgaattaagagcgcgcagattatcacgatgtgcgatattgataatccaatgtatggaaaatcgggggcagcttatattttcggaccgcaaaaaggtgcggatgatgaaatggtgcagcagctggatgcaaacttaagaaaatttgcagagcggatacagacagaaatcggaaaagatatttcgaatatccatggaggcggagcagcaggtgcaatgggagccggtatggttgctttctttgattcaaagcttcagatgggaattgaaaccgtacttgatattgtaaaatttgatgaattaatccagggtgcagatttgattttcaccggtgaaggaaaaatggacagccagagccttcgtggaaaagtggtaattggagtcggaaaacgggctaagagacaagacgttccggttgtggttgtgacaggagatgcagaagaagtagaagatgcttatgatatggggatttcggcagtcttttcaacgaatcgggtagcaagagatttttcagtaatccgatataagagtaaagaatatatggaagtcacaatggataacattatgaggctgattaaaattgtgaataaatagggagaaattagaaaaaataaaaagagcggagacttggattttaggtgagtccccgctcttttaaatttaagaggtttttgtatatggattagaggtaagttttttatttaaccaaatcaagcaagtagcgaagcggattgcgaatatccacttgactttaatgtgtatagttattaagtagaaaaatttataagttcgagtaacccatcagggaagcgtccactgcctcagcagcttttcgtccttcacggattgcccatacgaccagagactgtcctctgtgcatatctcctgcggtaaatacgccaggaacagaagtttcatactggtcagattttgttgcaacattggttcgtggagttaagtccactttaaatgcatcggttacgtatttctggcttccaaggaaaccggctgcgattaatacaagctgagcttctatgatggtttcactgccttcgaccggaaccatattcatacgtcctgttttttcatcttttttcggttcaagctttacaagttttgctttttgtacgttacctttgtcgtctttgataaattcggttactgtggtctgatagatacgtgggtcatgtccaaagactgcgatagcttcttcctggccgtaatctgtcttgcagatacgaggccattccggccatggattcatttctgttctttcatctggtgcttttggcatcatctcaagctgtgtgacagattttgcaccaagacgaattgcagttccgacacagtcatttccggtatcaccgccaccgattacaacgacgtgttttccttttgcagaaacaaagtttttatctttgaaattggaatctaaaaggctctttgtaatagaagagaggtagtcaactgcaaagaaaatattgttggcttcacgtcccggaactttaatatctcttggattagaagcgccacagcataaaacaatgcggtcaaaatctttttggagttcttttgcagtgatatcttttccgacatctacacctgtcttaaagacaactccttcttcttccatgattttgatacgtctgtcaatcacagatttatcaagcttcatgttcgggattccatagcggagcaaaccgccgattctgtcttttctttcaaaaacagtaacctgatgtccgcgacggtttaactgcatggcagttgcaagaccggacggaccgcttcctacaacggcaacttttttgccggtacgaacttttggaatccttggagtcacccatccgtttgcataagcagtttcaataatggcacgttcattttcctttgtggaaaccggttgggaatccagattacagatgcaggctgcctcacaaagggcagggcatactctgcaggtaaattcagggaaacaatgggttttggttaaacgggtataagcttgttcccagtttccgtgataaactaaatcatttaattccggaactaaattgtgaagcggacatccggaagccattccggcaatcattgtaccggcctggcagaacggaacgccacattccatgcagcgtgcgccctgtttctgttgttcctctttttttaaaggggtacgaaattcgttaaagtgtttaattcggtcttttggtgcttcgacttttgctgtctctcttttatattctaaaaatcctgttggttttcccatgattattctgctcctttctgaaagttttcattgaaggcttctaactgtgcttcttctggtgacatgcccatttcttccagtctggtagccatagtaatcatctttttgtagtcatccggaataatctttttgaatttcggcagatattcctggaagtggtcgagtacttcctgacctttttcagaaccggtagcagcaacatgagctgcaatcatgttatgaagttcctgaatatcagattttaattctactttttcaatagaaatcatagatttattcaggtttttatacaattcatttttatcatcaagtacataagcgacaccaccgctcataccagctgcaaagttcttgccggttttgccaaggacaaccacacgtccacctgtcatgtattcacatccatgttcgccgacaccttcaacaactgcgtaagcaccggagttacgaactgcaaaacgttcaccggctacaccacagatataagcagtaccgcttgttgcaccatagagagcaacgttaccggtaataatgttttcatctgctttataatttcttttcttcggaggataaagtacaatcttaccaccggagagacctttacccatgtaatcgttgcagtcaccgcagagagttaaagtgagtccttttggaacgaaggctgcgaaactttgtccgccggctccattacagttgatggtgatggtatcatctggcagtccgtctttatgatgtcttgtaatttctgcgccaaggatggtagcaaatgcacggtctgtattggtaacttctacatcgatagaggctttttcgcctttttcgatggatttctgaagttttttcagaagaattttttcatcttttgtctcttccagtttgaagtcataaacctgagccgggtcgaaggttactttctgtccttctttggcgaatggattatttaagattgcacttaaatcaatcttagatgccatcgggctttccggatgttcttttacttttaagaggtctgttcttccgaccatctcatcgagtgtacggattccaagttttgccatgtattcacgcagttcctcggcaataaagcgcatgaagtttacaacatattccggttttccacggaaacgttttctaagttccggattctgagtagcaacaccaaccggacaggtatctaagttgcagactctcatcataacgcatcccattgttacaagcggagcagtagcaaaaccaaattcttctgcaccaagtaaagctgcgattgcaacgtcacgtccactcattaatttaccatcggtctcaatcatgacacggttacgaagtccgttcataagcagagtctgatgagtttcagcaagaccgagttcccatggaagtccggcattgtggatagaactctgcggagcagcacctgtaccaccgtcataaccggaaatcaggataacctgtgcaccggcttttgcaacaccggctgcgacggtaccgacaccggcttcagaaaccagttttacggaaatacgggcatttttatttgcatttttcaggtcgtagattaactctgccaaatcttcgatggagtagatgtcgtggtgcggtggcggagaaatcaggctgacacctggagtggaatgtctggtttttgcaatccaaggataaactttcttagcaggtaagtgtccgccttcaccaggttttgctccctgtgccattttaatctgaatttcttttgcactgactaagtaacggctggtaacaccgaaacgtccggatgcaacctgtttgattgcagaacaacggtctactttgcttccggcactgtcaagacgctcatcactttctccaccttcaccggtatttgattttccgtgaagcatgttcattgcgattgcaagtgtttcatgagcttcctgagaaatagaaccgtaagacattgcaccggttttaaagtgttttacgatttcatctacactttctacttcctcaatcgggataggattttcagcaaaattgaaatccatcaaacttctcagataaccactctgttctttatcaaccatgctggtgtactgtttgaataggttataatctccacgtttggttgcctgctgtaatgcatgaatggtctgtggattgtaacgatgtttttcaccttcactttttgctttgtgcataccaagactgtcgagctgaagatttgtggtaagtccaagtgggtcaaatgctttggagtgacgggcatcaacatctttttcaatatcttttaaggtaataccaccgacacggcttacagtaccggtgaaatatttttcaatgacatcggcggaaataccgattgcttcaaaaatcttagaaccctgataggactggatagtagaaatacccattttagaagcaatttttacgataccgtgaaggattgcggaattgtaatcatttacggcagcgtagtaatctttatttaataagttattgtcgattaattcctggattgtatcctgtgcaaggtaagggtttacggcacatgcaccataaccaagcagggtggcaaagtggtggacttctcttggttcaccggattcaagaatgatggcaagagaggttcttttctttgtttttacaaggtactgatgaactgcggatacagctaacagagatggaatcggcatgtggttttcatcgaccccgcggtcagagagcactaagatgtttgctccatctttataagctttgtcaacttctacaaaaagacggtcaattgcacggtcaagcggtgcactcttataataggtaatcggaacaacagccactttaaatccttttacattcatgtgtttgattttcagcatatctgtgttggtcaaaatcgggttgttgacttttaatacctggcagttttcaggctgttcgtgaagcaggtttccatcttttcctacataaacggttgtgctggttacaatttcttcacggattgcatcgataggcgggttggtaacctgtgcaaaaagctgtttaaaatagttaaataatggctgatgtttttctgaaagaacggcaagtggagtatctgtacccattgcagcgattccttctgaaccatttaatgccatgttataaatggactgacggtattcttcgtaagtgtagccaaatgcctgctgcatttttgtcagttccgtaccttcataatcctcaacacgcacgtttggaatttttaagctctttaattcgaccagattgctgtctagccattcaccataaggctgtttggttgcatatctttcttttaaggtatcatcatctacaatttccccttttacagtatcaactaaaaggatttttcctggatgcagacgttcttttaatacgatgtcctcttcaggaaccggcataacgccaacttctgaagaaaggataacgtcaccgctctttgtgatatagtaacgggatggacgaagaccatttctgtcaagtacagctcccataacatcaccgtcagagaacaggatggaagcaggaccgtcccaaggctccatcatagttgcgtagtactgatagaaatcacgtttttcctgagttaaggtctgattgtttgcccatggttcaggaatacagatcataacggcaagtggtaaatccataccattcataactaaaaattcaagagtgttgtcaagcattgcggagtcagaacctctggtatcaacaaccggaagtactttatgaagctgtccttttagatagtcagaagccatggtttcttcacgggcgagcatcttatcggcatttccacggatggtgttgatttcaccgttatgtaccataaaacggttcggatgagcacgttcccagcttgggtttgtgttggtactgaaacgggagtgaaccattgcgatagcggattcataatctgcatcctgtaaatctttaaagaatgtacgaagctgtccaacaaggaacatacctttgtaaacgatggtacggcttgacatggaagcaacgtaagtgttgtcattactctgttcaaatacacggcgtgcgatgtagaggcgtctgtcaaatggaagtcctttttcgacatcatcaggtttctggataaatgcctgaacgatatgtggcattttttcgagtgctttgtgtccaagtacttccggacataccggaacatcacggaatcctaaaaattccagaccttctttttctacgatgatttcaaacatctttttcgcctgattgcattttaattcatcctgtggcaggaagagaacggcaataccgtattctctttcgccaccgattttgataccctcttttttgcaggctttggaaaagaatttatgtgaaatctgaagcaggataccaacaccatcaccggtttttccttctgcatctttaccggctctgtgctctaagctctctacgatttttaatgcattttcaacagttttgtggcttttgatacctttgctgtttacaactgcaccgataccgcagttatcatgttcaaattgctgtcgatataaaccttgttctctcataatgattgacctctttcctttttatatgtggcagccgcctgcaccagtcctttaaatagcggatgtgcatgattcggtcttgattttaattctggatgaccctgagtaccgacgaagaatggatgctcggtaatttcaatcatctctacaattcgtccgtccggagaaagtccgacaagactcattccattttcttcaagctgtttacgatagtcattatttacttcatagcggtgtctgtgacgctcggcgatatcctgttttccatataattcgtaggattttgttccttcttttaatttacaaggataagaaccaagtcttaaggttccgcctaagtcttcgattccgtcctgttccggcataagagcaatgactggatgaagggtgtccggatttaattcaatgctgtttgcatcgtgatatccgaggacatttcttgcaaattcaataattgcaacttgcataccaagacagataccgaggaatggaattttgtgttctcttgcatactgaacggcaagaatttttccttcggttcctctggttccaaaacctccgggaacaaggattccgtcgagtccttttaaagattcctcataattttctatggtaagatgttcggaatcaatccagtggatgtggacattggcatgatttgcgataccgccgtgttttaaggcttccactacacttaagtaagcgtcatgaagctgaatgtattttccgacaattgcaatgtctacttctgtctgaggatgtcttaaatcgtttaccattgatttccagtcatccaaatccggttgtggacaaggaagttttagtgattcgcatacaacctgtgccagattttctttttccatggcaagaggtgcttcatataaatattctacatcaagattctgtaatacgtggctttgcggtacgttacagaataaagcgattttatctttaatatcctgaccaattggatgttcggaacggcagactaaaatgtccggctgaagtcccattccctgaagttcttttacacttgcctgtgtcggttttgtttttaattctccggatgcctttaaataaggaatcagagtaacatgaattaagatagcattttcatgtccgacatcatgctgaaattgtctgattgcttctaagaatggctgactttcgatatcacctaccgtaccgccaacttcgataatagcgattcgctcttcatcaggaaattttgcacggtagaaacggcttttaatttcatttgtaatatgagggataacctgaacagtccctccgccgtaatccccatgtcgttctttttgaagaacggaccagtaaattttaccggttgtaacattggaatttttatcaaggctttcatcaataaagcgttcataatgtccaaggtcaaggtcagtttctgtaccgtcgtctgtgacgaatacttcaccatgctggatgggattcattgtacctggatctacattaatgtaagggtcaaacttctgcatggtgacctgatagcctctggcttttaataagcgtcccaaagatgcggcggtgattccttttccgagaccggaaacaacaccacctgtaacaaatacatattttactgccatcacattttcctcctgctgttgtttcattatcagaaacaggttatgcggtcctgagtctgataaataagataatttcatgggattgccgtgaaatcaaaaaaaaggcgtcgaaactcccatagaaaatactatggaaattcgacgcctttgtcgttttctattcattatgtaagttatcagtcgttttcgggaagttcttggaactccgaaaattatgcaaatactatagctcatttttttttatttgtaaatcccttttttgaattttttttttgaaaaaatttttttaaaaaaagtgattgacaaatttctttttccgtgcaatactacatggcataaagcaaaggcgctttgaactacaaaagttcagagtgccttttttgtttttaccagagtcaaaaattgaaaaccaaaccaatccgtaggtaaaaacaaatttgagtaataattttaaaagcaaaaacaatcacatgaagaaaaatggaaaggagtgctgtgaatatgtcaaaagatattcctacactgtatggaagccttgttttcagtgacaaggtaatgcgtaacaaattaccgaaggatgtttacaaagctcttcgcaaaacaattgaaaatggaactcatctggaactggatgttgcaaattccgtagctgttgccatgaaagagtgggcagtagaaaacggagcaacacatttcactcattggttccagccaatgacaggatttactgctgaaaaacatgacagctttattactccggttggagaaggcgaagttatcatggaattttcaggaaaagaactggtaaaaggtgagcctgatgcttccagctttccatccggtggtttaagagctacatttgaagcaaggggttatacaaactgggatccaacatcaccggctttcattaaagataataccttatacattccgacagcattttgttcctggagtggagaggcgctggataagaaaactccgcttcttcgttctatggaagcgttaaacaaagaagctgttaagattttaaatttattaggaaatacagaagtaacaagtgttacaacaacagtgggtccggaacaggaatatttcttaattccaaaagaattatatgcaaaacgccgtgacctgatttttaccggaagaactttattcggagcttccgcaccaaaaggacaggaaatggaagaccattactttggtgcattaaaaccaagagttgcagcctacatgcatgatttggatgaagagttatggaagcttggtattccggcaaaaacaaaacataatgaagttgctccggcacagcatgaactggcaccggtatttgataccacaaacgtagcggttgaccacaatcagctgacaatggaaattatgaagaaagttgcagaaaaacatgaccttgtctgcctgcttcatgaaaaaccatttgatggaatcaacggaagtggaaaacataacaactggtctgtttctactaatacaggagtaaacttattagacccgggaaaaacaccggcagaaaatattcagttcttagtgttcttagtagcagttatcaaagcggtcgatgaatatgctgatttaatgcgtgtttctgcttcaggagccggaaatgaccatcgtcttggtgcaaatgaagcaccgccggcaattgtttctatctttatcggagatgaactgacagaagtcttaaaatcaatcgaagaagataaattcttcagcgcacataaaacaattcagatggatatcggtgctcatgtacttcctcattttacaaaggatacaaccgatagaaaccgtacatcaccatttgcatttaccggaaataaatttgaattccgtatgcttggttcttctgcatctgttgcaggtccgaacgttgtattaaatacagcagttgctgaggctctggcacagttctataaagaactggaaggaacagcaccggaagatatggaaacagcagtgcatgaattaatcaaacgggcaatcagaaaacataaaaaagtaatcttcaatggaaatggttatacagacgaatggattaaagaagcagaggagagaggactttataatctggtttctactccggatgcacttccacagtttatcgctgataaaaacattgaattatttacaaaacatagtgtatttacaaaagaagaaatttattctcgttatgaaattttacttgagaactatgtaaagactatcaatattgaatctaagactttacaggaaatgctgacaaaagattttattccggcagttaacggatatgcagcagaagttgcagtcaatgcaaatgaaaagaaagcattaattgagggtctgtcaacaacagccgaagaatctcttgtaaaagaattaacagaagcttctaatatcttatctgcaaaagtagcagaattaaaagttgtaacagaaaaagcagatgcggcagcagaagaagatatgcagaaagcagcagaatctttccataaagatgtattaactttaatggatgaaatgaaagatgttgcaaattcagctgaggaaaagattccagacgaagaactgccttatccaacttatgaccagatgttattttatgtttaaggagagggagtcatggaattcttaccagaatgtgaaataaaagaagaatgtggtgtatttggaatttttaatccggatggcggagatgttgccccatctatctactatggactgagttcacttcagcatagaggtcaggaatcctgtggtattgcagtctgtgataccatgggaccaaaaggcaacatgaatgcacataagggtatgggacttgtgaatgaagtatttaaagaagaaactttaaataatcttcacggaaatcttggagtcggtcatgtgcgttactccacaaccggagctgcaaatattaataatgcacagcctctggtattgaattatattaagggaacacttgcgctggctcacaatggaaatctggtaaatacagcagagcttcgctcagagttggaacgaaccggtgcaattttccatacaacaactgattcagagctcatagcctatttcattgcaagagaaagggtaaatgcccacaatgtagaagaagcaattcttcatacagcaaaaaaaattcgtggcgcttatggattggtaattgccagtccgcgtaaactcattggcgtcagagaccctcttggcttaaaaccactttgtctcggaaaacgcgatggaagttatatgattgcctctgaaagctgcgccctttctgcaatcggcgcagaatttatccgtgatatccgtcccggcgaaatcgttacgattaccaaggacggagtcacatcgaattgtcagctttgccaggaaaaaagagcacattgcatttttgagtacatttattttgcaaggcttgacagtacaatagatggtattaatatttacgatgcccgtattcgtgcaggtgccgcacttgcggctgcttatcctgtcgatgcggatttggttgtgggagttccggactcaggtattcccgcagcgaagggctattcagaagcttccggaatcccgttcggaatagccttttataaaaacagctatgtgggaagaacatttattaaaccgacacaaaaagaacgtgaatccagtgtacgcttgaagctgaatgtattagagccggttgtccgtggaaaacgaattattttagtggatgattctattgtccgtggaacaacaatggcaaatctgattcggatgctcaagaaagcgggagcagtaagcgttcatgtacgtgtgagttctccgccgttcctgtatccttgctactttggaacggacattccatccaacaaacaacttattgcgtcttcccacacagcagatgaaatcagagagataatcggtgcagagtcacttggttatatgaaattagaagacttgcagtcaatggtaggagaactgccaatctgcagggcatgtcttgatggaaagtacccgatggatattacaggacataccgaggacaaaaaacagtaattgcggaaatgtaaggcattttccgattacatatatcacattcgatacctggaaattgctggtctaaaaaacagcttttagactttcgaccctggtatcatcacatttttctttatgcgacggtgcgtattttgtgagagcaaagtgcgcacctttttgtattttagaaaaatgttgtataaataaaatttagaaaaatgtgagcttgaggaaaggggaaattaatatggattattcagcagtaaatacgatatgggtgcttcttggcgccgcattagtattctttatgcaggctggtttcgctatggtagaaaccggttttacccgcgcaaaaaacgccggtaacattattatgaaaaacttaatggacttttgtatcggaacaccggtcttctggctggttggtttcggaattatgtttggtgcgggaaatggcttttttggttcgatttccggtatcgcttcagaaagtaattatggaacagcaatgcttccggatggagttccgttttgggcatttctgatttttcagacagtattctgtgcaacatctgcaacaattgtttccggtgcaatggctgagagaacaaaattctcatcttactgcatctacagtttcttaatcagtttagttgtttatccggtatctggtcactggatttggggcggcggctggttagcacagatgggatttcatgatttcgccggttcctgtgccgttcatatggtaggtggcgttgctgccttagttggtgcaaaaatcttaggacctcgtattggaaaatattcaaagagtggaaaatcaaaagcaattccgggacataacctgacaatcggtgcacttggtgtatttatcttatggttctgctggtttggatttaacggtgcatctaccgtttccatggaaggcgatgcaattgtaaccgcaggtaaaattttcgtaacaacaaaccttgcagctgcagttgcaactttaaccgtacttgcaatcacatgggtaagatacaaaaaaccagatgtatctatgtccttaaacggttccctggctggtctggtaggaatcaccgcaagctgtgataccgtatctccgacatctgctgcaattatcggtatcttagccggatttgtagttgtatttggtattgaatttatcgacaaagtatgtaaaattgatgacccggttggtgctgtcggtgtacacggaatgtgtggtgcacttggaaccctttgtgtaggtcttttctctgatggaacaggtacagagtggaaaggacttttcacaggcggtggatttaaattattagaagttcagtttatcggatttatcgcaaccgttgcatgggttgttgtaacaatggttatcatctttaatgtattaaaacataccgtaggtcttcgtgtatctgccgatgaagaaatcgcaggtctggatatcagagagcatggtcttgcaagcagttatgcagactttgttacaacagataacatgggcggtggaaatgttccaaacgtaatgggaataaagagaggaccggtagaatctccggctgcaactcaggctccggcagaactggtgaaagatccgaaagttggtaccgatgtacataaactgacaaaagtggttattattacacgtagaaataaactcgatgactttatgcaggcaatgaatgaaatcggtgtaacaggtgttaccatcacaaacgtattaggctgtggcgtacagaaaggtgcaaccgcttactatcgtggtgttgaaatggatatgaacctgcttccgaaagtaaaaattgaaatcgttgtaagcttagtaccggtcgaaaaagtagtggaagctgcaaaagcagtgcttcataccggacagattggtgacggtaaagtcttcgtatatgatattgaaaatgtagtgaagattcgtaccggagaagaaggttatctggcacttcaggatacctcggaagagtaaaaaagttaaaaaaaaagaccatctaaaaaaagatggtctttttctattgacaagaaaaatcgagattgctataataccaaacataaatgaaagaacaaaggcgttcttatttggagggtaaaactctctaaataagagcgccttttttgttgattgaataaaaaaacaactcgtaagagagaggagattatgcatggaaaattacacgaaggaagccatattgcagatggcagaagaggaagatgtcgaatttatccgtcttcagtttacagatatgttcggatgcctgaaaaatattgcaattccttacagtaaactggagaaagcgatggataataaatgtgtgatcgacgtttcttctattgaaggatttgtccgtgatgaagaatatgacatgtatttatatccggatttatctacgttttccattttaccgtggcgtccacagcagggaaaagttgccagatttgtgtgcgatatttacaacgaagacggcactccttatatagaaagtccaagatatattttaaagaaagcattagaaaaagcgaaagcaaaaggttataccttgatggtcaatccggagtgcgaatttttcttattccataccgatgataatggaatgccgacaacaacaactcatgaaaaagccgggtatatggatttgagtccgattgatttaggtgagaatgcaagaagagatatggtattaacattagaagaaatgggatatgatattgaatcttctcatcatgaaattgcaccgggacagcatgagattgattttgaatattctgaggcgatggaaacagctgataaggtcatgacctttaagacagcggttcgtaccattgcaaaacgtcacggactgcatgcgacatttatgccgaagccgagagccggagtgaatggttcagggatgcacgtcaatatgatgttaatgaaagatggaaaaaatgtattcaccgacaaaaatgatgaacttggattaagtaaagaagcgtatcagtttatggccggtatttttgctcatatcaaaggcatgaccgcaatttgcaatccattggttaactcttataaacgtctggcaccgggatttgaggcaccgtctgatattacctggtcttcgagacagagaactgcactgatccgtgttccacaaaatgtagaaggtggaaccagattagaactcaggagtccggatgcatcttctaatccatatctggtactggcgctttgtctggaagcaggtcttgacggaattgagaaacagatggaactctcaccggaattaaaacgaagcataaggaaattaaacaaaaaagaaaaagaagaaatgggaatcgattccctgcctgagaatttaaacgatgccttaaatgagtttcatgcagatgaattggtcaaagaggtattgggaaaagattttacaaaatattatctgaaagcaaaaaaagaagaatggttagaatacatggagcaggtatctgagtgggagcttgaacagtatctgtaccgtgtgtaaaaaataaagagcaggaggcagtacatgagcagcatcattattgtattaccaaaaatcgaagatgcgaaaaaaatcaggaaaatactgatgcagcatggatttgatagtatcataccatgcgctacaggtgcctctgcccttatggaaatgaataaacagtccggagggcttgtaatcagcggatataaacttccggatatgtattacaccgaactcgcagacatgcttccgagtttttttgatattttattgattggttcagcaaatgtggtaagttccgcacagtcaggaatcatggcagtcacaatgccgattcgggttcatgaactggttaacaccgtggaaatgcagatgatgcagattcagcgtcgtttaaagaaacagaaaaagaaaccaaaaccaagaagtgagagggagcagaattatattcagaatgcaaagcggcttctgatggacagaaaccatttgacagaggaagaagcttacagatatatacaaaagtgcagtatggacagtgcaaccagtatggtcgagactgcacagatgatattgactttaatctatgatgaagtataagcataaagacaagtataagcataaaggagaaatgtgatatgtttacaattaatgaaaattatctgaaactgccgggaagttatcttttttctaacattgcaaaaaaggtaaatgcgtatcaaagtgaaaatccggaggcacagattcttcgccttggaatcggagatgtcacacaaccacttgcaccggcaatcattgaggctctgcataaagcagtagatgagatggcaaatgcagaaacctttcatggttatgcaccggaccttggttatgaatttttaagaagtgctattgcaaaaaatgattacaaagaccgaggctgtgatattgcagcagatgaaatctttgtatccgacggtgcaaagtgtgattccggtaatattcaggaaatctttggcttagacaacaaaattgcagtatgcgacccggtttatccggtttatgtagacaccaacgttatggcaggaagaagtggggaatataatccaaatactcagaactttgatggcatgatttatatgccgtgtctggaagcaaatgattttgtgccggagttcccaaaagagaatccggatatcatttacttatgtttcccaaataacccgaccggtgccacaattaccaaagcacagcttcaggaatgggtagattatgcaaaacgtatcggtgcagtgattatctatgatgcagcgtatgaagcatatattacagaggaagaaatcccacacagcatttatgaatgtgaaggtgcaagagagtgtgcaattgaacttcacagtttctcaaaaaatgccggatttacaggcgttcgtcttggatataccgtagttccgaaagatttaaaatgcggtgatgtacagcttcattctttatgggcaagacgtcacggaacaaaatataacggtgctccgtacattgtacaaagagccggtgaagccgtttattcagatgccggaaaagctcagttaaaagagcaggttgcttattatatgcagaatgcaaaagtgatttatgaaggcttaaaaaatacaggatattccgtatccggcggtgtgaatgccccttatatctggttaaagacaccggataaaatgacttcatgggagttctttgataagttacttcatgaagcaaatgtagttggtactccgggaagtggatttggtgctcatggagaaggatacttccgtttatcagcattcggaagtcatgaaaatacaataaaagcagtagagcgaattacaaagatgtaataacaggcgtgagaacgcgtgatttgcgtcccggggtctggatgccccgggatgtctgtttttaaaaacgcgataaaggagaaatgtgatatggaatttgttacaggtgtaaaagaaaaagaagcaatggaactgccagaagtgatcatacaggaagaaggaacagaagttatcgtagagggtgcaattcacagtatccgaaatatgggtgagattgcatttgtcatcttaagaaaaagagatggtctcattcagactgtatgggaagaaaataagacaaatctggatatctctgaattaaaagaagctgcctgtgtcagtgtaaaaggagtcgtaaaagacgaagaaagagctccgcacggaaaagaagttcgtctggaacaaattaccattttatcacagccgactgctccgcttccacttgcgattgataaatggaaattaaatacctcacttgaaacgaaactggatatgcgttcggtttctcttagaaacttaaaagaaagagcgagatttaaaattcaggaggcaatctgcagaggatttcgtgagtatctttatgcacaaggctttacggagattcacactccaaagattggggcaaaaggcgcagaaggtggttccaatatgtttaagttaagttatttccatacaccggccgtgctggcacagagtccccagttttataaacagatgatggttggggtgtttgaccgtgtcttcgaaaccggcccggtttttcgagcagagaaacacaacaccagacgtcatttaaatgaatataccagtcttgattttgagatgggatacattgacagtttccttgatatctgtgaaatggaaaccggatttttgcaatatacgatagaattattaaagaaagattatgcaaaggaattaaagatgcttggaatcacacttccaaacgtggaaaaaattccatatgtccgctttgatgaagcaaaacgtctggtatctgaaaaatataacagaaaaattcgcaatccatttgacttagaaccagaagaagaagagttaatcggtaaatattttaaagaagaatatgatgccgattttgtatttgtcacccattatccgtcaaagaagagaccgatgtatgcaatggatgacccggaagatgacagatataccttaagctttgacctcttatttaaaggacttgagatcacaaccggaggtcagcgtattcatgattataacatgctggtagaaaaaatcgaaaagagaggcatgagccaggaaggaatggaacagtacttagataccttcaaatatggcatgccgcctcatggtggacttggaatcggactggagcgactgacgatgcagcttttaggagaggacaacgtaagagaagcatgtctgttcccaagagatatgaaacgtttggagccgtaagaaaggagaaacagccatggcaaagcagataattgatgatacagtaatggaaaatgtagaaattcttgcaaaacttgcccttacggaagaagagcggaagaaagcaaaagaaaaaatgcaggaaatgctggattatgttgataaattaaatgagttggataccgatggaattgaacctctgtcccatacattttctatgggaaatgtattccgtgaggatgtagtcaccaatggagatgacagggatgcaatgcttgacaatgcaccaaaatgcaaagacggacagtatcaagtgccgaagacggtacagtaggaggaaagggtatggatttgaaagatttaagtgctcttgaactttccactgcgattaaaaaaggagaagcaggtgtggaagaagctgtaaaggtgtcactcgaacagataaaaaaatcagaagacactgtacatgcatttcttgagacagatgaagaaaaggtatatcaaagagtaaaagaagtagaagcaggaattgcttccggaaaatatagcggaccgcttgcaggtgttccgattgcagtcaaagataatatctgcacaaaaggcagaaagacaacttgtgcatccaaaattcttggaaattttgttccgccttatgatgcagaagccgtgaaaaaattagaagaagccggaatgattattcttggaaaaacaaacatggatgaatttgccatgggaagtaccagtgagacatctgcatttggaattaccacaaatccatgggatcagacaaaggtaccgggtggatcttctggtggttcatgtgccgcagtggccgcaggagaggctttcctggcacttggttcggataccggtggttcgattcgtcagccatcttcttactgtggtgtggtcgggatgaagccgacttatggaacggtttctcgttatggattgattgcgtatgcctcttcacttgatcagattggaccggttgccaaaaatgtggcagactgtacggctttattagaggcaatttccggatacgataaaaaagacagtacctcgattgaaagaaatgatttgaactttacagaagcgttaaacggcgatttaaatggggttcgtgtcggtattcctattgaatatctttcagagggactcgatgaagatgtgaaaaaaacacttcaggaaaccgtagaactgatgagggcaaacggagcagtggttgaagaattttctcttggactcgttgactatgtgattccggcttattatatcattgcttccgctgaggcaagttccaacctggcgcgttttgatggcgtaaaatacggttatcgcgcagagaaatttgaaggacttcatgatatgtataaaaagagtcgtgcacagggatttggagaagaagtcaaacgaagaatcttacttggttctttcgtattaagttccggctactatgatgcgtattatttgaaagcattaaaagtaaaagccatgattaaaaaagcatttgatgatgcatttgcaaaatatgatatgattctggcaccggcagcaccgtctaccgcaccgaaggtaggaagcagtttacaagacccgcttaaaatgtatttaagtgatgtctacaccgcaggggtaaatctcgcaggtcttccggcaatcagtgttccggcaggaaaagacagaaatggaatgccggttggtcttcagtttatcggagactgctttaaagaaaagaaaattatacaggcagcttatgcttatgaaaaaatccgtggagtatttcctatggcatatcagaaggagggaaaatagatggcaaaacaatatgaaacagtcattggacttgaagttcatgtagagcttgccacagcgaccaaaatcttctgcggatgctctacgaaattcggaggcgcaccaaatacacatacctgtccggtctgcaccggtatgccggggtctcttccggtcttaaacaaacaagtggtagaatatgcacttgcacttggacttgcagcaaactgtgaggttaatcagaactgtaaatttgaccgaaagaactatttctatccggataacccacagaattatcagatttctcagttatatctgccaatctgccatgatggatttctggaaatccagaccaatgcaggaacaaagaaaatccgtattcatgaaatgcacatggaagaagatgcaggtaaattaatccatgatgaatgggaagactgctccttagtagactataaccgaagtggggttccgcttgtagaaatcgtatcggaaccggatatgagaaatgcagaagaagtgattgcatatctggaaaaattgagaatgatttgtcagtaccttggtgtgtctgactgtaaattacaggaaggttcgatgcgtgccgatgtcaacttatccgtacgtgaagttggcacagaaacctttggaacaagaacggagatgaagaacttaaactcctttaaagcgattgcacgtgcgattgaaggagaaagagaacgtcagattgaactcatagaagaaggaaaagcggttcagcaggagaccagaagatgggatgacaacaaggaatattcctatgcaatgcgttccaaagaagatgcaaaagactaccgttacttcccagaccctgatttaccgccggtctttatcagtgatgaatggataaaacgtatcaaagacagccagccggaacttcaggaagcaaaatctgcacgttatgaaaaagagtatggactttccgtttacgatgcttcacttttaacccagtccaaacatcttgccgatttatttgaagaaaccgtaaaagaaagccagaatccgaaaaagaccgcaaactggtttatcggtgaaaccctgcgtctgttaaaagacagaggaatggaagcagaagaactgcattttactccaaaacatctggcagatttaattcttatggctgaaaaaggagaagtcaataaccagaatgcaaagaaagtctttgaaaagatttttgatgaagatgtagaaccgaaggcttatgtagaaacaaatggattaaagaccgtagaagataccggtatgcttgaatctgttgtcgataaagtacttgcagataacccgaaaactgtagaagaatatcatagcggaaaaacaaaagtgcttggattcttagtcggacaggttatgaaacagatgaaaggcaaggcaaatccggcgtctgttaataaaatgctgatggagaaactgtgattaattgcatgcctgtttcttttaccgaaacagtagaaattatttttggagccatagaatagtagaaattgtattttaaaaatattggctagttcggggacagaaatcttgtccccggacttttttatttcataggattctttttatgtgctatgcttcattcttctcattctgctcaaccagataatccagtgaccgaaactgataccccatctcttcccatttgccaagcaattcatctagaatttgagcattggttgatgaggtgctgtggagcagcacaattgcgccggggtgaatccggttaagcagtttgtcgaaggcttcttcttttgagggctggttatcctggtaccagtctacataagcaagactccagaagaaggttttataacctaaatcttttgccatttttaagttggtttcgctgtatttgccttgaggagggcgataatattttttcatttcctgtccggtagcctctttgtataaatcagaaagttcctgtaattcttttgagaaggaatcaatggaagaaatctgagacatatccggatggtgataagaatgattgcctacgatatgtccgtcggaaatcatgcgtttgacaatttcaggacttgtggagagaaaatttccaacgacaaaaaaggtcgcaggggcattgtgcttttttaaagcatctaaaatgatttcagtattgccattttcatatccgcagtcaaaggtgagataaatatttttttcatcggtgtcttgtgcatagtaggcgtcatattgctgtaattcttcgatagaggcatttccgacaggacgttttccttcttcctgaaagcttagcccccagttgccgactgcattggaaatggtttcctgtgcggagtaatagtggatggcaaagcttaaaaaatttccaaatgcaaaagaagcagtaagcaataaaaaaagtgcaagatactttaaaataaaatttctatgtaacataaaaaatcctaaatgcattgttgttacctaatatattgagaaaaaaggaaaaatatcacagaaaaagtgagattgcgaaatcctcaaaatcatgttagagtaaaaaaacagaagagaaagataaagagaggagaacaaaggtgaatagaaaattaattttctttgatatagatggaacaattattccggaagatacaggagtaattccggaaagcacgaaagaggcaattaaaaaagcaaaagaaaacgggaatctggtttttattaatacaggacgtacttttagcggaattacccagccgatttttgatttggaatttaatggttatgtctgcggatgtggaacgcatatttattttgatggaaagaaaatctattcctctgtgattccgaaagaaaaatgcattgaaacggtagctattcttcgaaaaaataaagtaaatgctttttacgaaggagacaagggaatttattttgattacagctattcgaatccgtttatggaacgggcaaaaaaaatgcttagaacgaatggtaaatcggttgaagtgatattagaagataaggatgaagtatttgataaatgcctgattaaattcacagatgaggatatcaataagaaagatatcattatgccattttttgaagcaaattattattgtattgaccgtggagaagatatgtgggagatggcacagaaaggtcacagcaaggcaacaggaatccagaaagtctgcgaatatcttggggcagatatcgatgactgtattgcaattggcgacagcaccaatgaccttgatatgttaaaggcagtaaaaaacagtgtggcaatgggaaattccatggagagcattcttccttactgcagttataagacaacagatattaaggaagatggaatttataatgcactggtatattttggaattatctaatgtttccggtagattgttttttcaaggtttagatattcgcgaaactttcttggagtatatccggtcatttttttaaactgattgctaaaatcggcagcatctttaaagccacaggaataagcaatttctgtaatgctgtagtctgaagaagaaagcatatcagatgcaatgtggattcttaattgaagcagatattgtttcggagaaattttctgctgttccataaaaagacgatagagataagtccgatcaattccaatagcggctgcaatgtcctgaatacggatgttgtagccgtaattatttttcatataatccattgcgcgttttacatattgagtggaataagagtttccttctacaacagacggaccagtcatcaaaccaagaagttcaagaaacaaacctgtcagagtaaaaggattatagttggctgaagagaaagtatttaagatagaatgcatcagagtccgcagattcaactttcgttcagaatcaggaggacaaataaaaatacaggagtcctgaaaacaggtctggtttaaaagggcagggatttcctgtccattaaagccaatccatgcatattcccagggattggtttggtcggcttcatagtaggtagagtccattggtttgattagaaaggagtctccggacttgagagaatacgtatgtccttgatgtttaaaaataccttttccggaaagtacaacatgaatcaaataatgaggacgtacggcaggaccgaaagagtgtccgggctggcagtgttcgtgaccacaaaaataaatagatggaattccggacagagactggttcataaataaaatcctccattttacaacatttttacaagttttgagaaacaaatcagatagaaagtccttttctttgattatataataagaatcataaaaagacaacggattatgataaaatcaaggaggatgaaaaatggcaaaaataacgtttatgggagcaggaagcactgtttttgcaagaaatgtattaggagactgcatgtgtagtgaagcactctgtgaaagtgaaattgcattatatgatattgatgcaaaacgtctggaagattcagagattattttaaatgcaatcaacaaaaatgtaaatgagggccgtgcacagattaaaacatatctcggtgtggaaaatcgaaaagaagcacttagaggagcagattttgtggttaatgcgattcaggtgggaggatatgacccttgtactattacggactttgaaattccgaaaaaatatggtttaagacagacaattgcggacagccttggaattggcggaattatgagaggtctgcgtacaattccggtgatgcaggaatttgcaaatgatatcgaagaggtatgcccggatgcattatttttaaattatacaaatccaatggggattttatccggctatatgcagagatatacaggggtaagaaccatagggctttgccacagcgttcaggtatgctcaaaagatttattgacgaagcttggcatggaagataaattagaaggtcgtgtggaaacaattgccggcattaatcatatgggctggctgttagatatccgtgataaagatggaaatgatttatatccggaaatcagaaaaagagcagccgagaaaaatgcaacagaaaaacatgatgatatggtacgttttgagtatattaaacgtttgggttattattgtacggaatcaagtgagcacaatgcagaatacaatccattctttatcaaggcaaaatatccggaactaattgaaaaatacaatattccgttagatgaatatccaagacgatgcatcaagcagatcgcagaatgggaagaagagaaaaacaatatcttaaaagacggaaagattacccatgagcgaagcagagagtatgcatctcatattatggaagcagttgtaaccaatcagccgtataaaattggtggaaacgtaatcaataaaggcatgattgaaaatcttccggcggatgcctgtgtagaagtaccgtgtatgattgacggaaatggagtcaatccatgcagagtcggaagacttccggtacagctggctgcaatgaatatgacaaatatcaatgtacagctgcttaccattgaagcagcagcaacgaaaaagaaagaatacatctatcaggctgcgatgcttgaccctcatacagcaggagaactttgcattgatgatattgtaaaaatgtgcgatgagttaattgacgcacatggagattatatgaagatgtataaatagtgataaagtttcgcattgacttgacggaaatcgggtatcggcttataatcaaattcacctgaaaaaggcagttggaggaatatgattatggcaatgaatccagtaaagttaatgcagataaaagcgacaattgccggagtagagaggcggcatccgaatcttcgaaagttttttgaggcagttggaagagaaaaattaagagaaggaacgattttggaactgaaggtgcagacaccggaagggaaaaagctgatttccaatgtaaaactgaccaaagaagatgaaaaattaatttcagagctgttaaagaataaagacaccttgctttaaaaaagcaccttgcttaaaaagcagggtgtttttttcttgacaaaggtaagaattgggagtaatataatgctaaaatgttcacgaaaattaaaaaggtggattacatgaatatacaagaatatgatattatgaacgaaatcgcagaaagcggttatgaaaatcagagaattttaacagaaaagacaggatattctcttggaaaggttaatcagtccttaaatgaattgattcagaaagagtatcttaccaaagaatatcaattaacagaaaaagcagaagcggagtttgaaaagaaagctccgaaaaatgcaattattttggcagcaggttatggaatccgaatgatgccgatgaatcgggaagtgccaaaggggttaatcgaggttaatggagaaccgttgattgagcgcctgattcgccagcttcatgaagccggaatttttcagattgatattattgtcgggtttatgaaagagcagtatgaatatctgattgatgaatatcaggtgaatctgattgtcaatcgtgaatatgcccagtacaataatcttcattctctggcacttgcaaaagacaggatttcaaatacatatattattccgtgtgacgtctggtgtgaaaaaaatccattttccaaaagagagctgtattcctggtacatggtgacagatttggtggatgacgaaagtgatgtcagagtcaatcgaaaattagagctggtttcggtagatgcagaaaaaagcggaaatgcaatggtaggcattgcttatatccttgaagaagaagcagaagaacttcagagccagataaaagaaatgtgtaagaaaaaagcttatgaaaacgtattctgggaaagcgctctaatgaaaaaaggtaaaatgtatgtatcagcgaaaatcgtgccgtcaagaagtgtttatgagattaatacttatgagcagttaagggaactcgatgacacgtcaaaacagttagactcagatgtgattcatttgatttctgaaattttggcatgtgagccgaatgaattagaagagattgaagttctaaaaaaaggcatgacaaatcgttcttttatgttcaagtgcagaggcaaacggtttatcatgaggattccgggtgagggaacagaaatgctgattaaccgaaagcaggaatatgaagtttatcaggtaatcaaaccgcttggtatctgtgattcgattcgatatatcaatccggaaaatggttacaaactgacagaatttatcgaagatgcaagatgctgtgattccggaaacccggaggatgtaaaagcatgtatggcggtgctccgtaagtttcatgaaagcggggtaaaggtggaacacacctttgatgtttttgaacggttggagttttatgaaaaattgtggaagggaattccgtcctgctatcgtgattacaagcaaaccaaagcgcatgtatatgaattaaaaaactatattgataagcaggaaaagcagatttcactgtgtcatattgattctgttccggataactttttaatgaccaaagacagaatcgcattaattgactgggaatatgcagggatgcaggatacagatgtggatcttgcgatgtttatcatttattccatgtacgggaaagaacaggcagatgctttgattgatgcatattacacagaaggatgcaaaaaagaaaaacgattaaagatttactgttacgttgcagtctgtggtctgttgtggagtaactggtgcgaagtaaaataccatgaaggtgttgaatttggcgagtattccttaagacagtaccgatacgcaaaagaatattataaatatgtaaaggaagaactggaaaatggcttataaagtagaaaatgcagttattatggcagcaggattgtccagtcggtttgcccctctttcttatgaaaaaccaaaagcgctgattacagtcaaaggtgaggtgctgatcgaacggcagattcgccagttaaaagaggccggaatccatgatattgcaattgttacgggatataaaaaagaaaaatttgaatacttaaaagaaaagtgtcaggtgacacttatcgaaaatccagagtatgcaaccagaaataataatggttcgatttattcggcaagagaatggattgggaatacttacgtgtgcagtgcagataattatttccctgaaaatccatttgaatcggaagtagaaggcagttattattcggtactttatgccgatggggagacgaatgagtggtgcgttacagaagatgaaaccggaaggattacttcggttaaagtcggaggcagagactcctggtatatgatgggacataccttctgggcagagccgtttagcaaacgcttttttgaaatcttagaagccgagtataacaaaccggaaaccaggaataaattatgggaagatatttatattgaacatatcgaagaactctcgatgaaaaccagaaaatataatcaagatgaaatttatgaatttgattctttagatgaattaagggagtttgatgagaactataaaacaaattccggttcagaaattttaaaacaaatttcggaagaacttcagataaaagaaggcgaaattaaacagcttgttccggcaaaagatgagaatggactggtaaccggagttaagtttgaaatacaaggaaaacagtttgagtatgactatcagctgaaaaagctgatacatggaggaaaaatcaatgaataaattagatcgcaaaagaatagactggctcatcacgttagctccttttattagcattatgttattagcgggtgtattatttgtatttccaaatgagtccaataacattataagtaaggtgcgattttttttcggtgatacagtcgggatttattatttagtaattggtttggcagttttgctggtttctgtttatttagctttttcaaagtatgggaatgtcgtattaggcgagccaaatgagaaaccgaaatattcattttttgtatggggaagcatgatgtttacttgtggacttgcagcagacattttgttctattcatttgcagaatgggtaatgtacgcaactaatccgcatatggaagaacttggctccgtggcagaatgggccggcgtttttccattgtttcattggagctttattccgtgggcattttatctggtacttgcagtcgtattcggttttatgttacacgtgagaaaaagaaatcgtcagagatattcggaagcatgtcgaccagttattgggaaacatgcggatggtgtgttgggacgtgtgattgacttatttgcattatttgcgctgcttgccggaaccgcaacgacatttagtgttgcaacaccgcttttggcagcaattattgtaaagctatttggtatcacgcttagccgaacagttgttacaatcatcattttattggttacctgtgcagtatatacttatgcagttttgcatgggtttaaaggaattagttttttggcgaagctgtgtatttatcttttctttggcttattattgatcgtgttgctaatcggtggtcaggggaaatttatcattgaaaatggcttccaaagttttggaaagatgttacagcattttatagagttaagcacatttacggatccggaacgcaccagtaatttcccgcaagattggacgatttattattgggcctattggatggtttgggcagtcgcagctccattctttattggtaacatttcacgtggcagaacgattaaacaaacgattcttggaggatatgtgtttggtgttggatcaacaattattagttttgtcgtacttggaaattatgggcttgggcttcaagtgagtggaaaagcagattttatttcccaatatgcgaaagatggagatctttacggactcattttgaatattatagatacaatgccgctggcaaaggtgattttagtaatcacagtgttatgtatgattgcattttatgcgacttcatttgattcgattgcatatacggcagcttgttatagttacaaggagcttggagaaaatgagcatccgcataaactgattgaattattatggtgtttactattgattgtactgccgattgcgttagtgttttcggaaagttcgatgaataacattcagagtatcagtatcatttcggcatttccgattggcattattatgattcttattttgataagtttctttaaagatgcaggaaaatatttagctgaatcaagtaaatctcctgattcaactacgaaaagcaagaagtagtgggtagagacttgctttttgtagagaacggtaaagaactggagaatttgatatgacacttatacagttaaaatatattttgacaatagcagaaacaaaatccctaaataaagcggcagagcagctttatgtttcacagccttctctaaccaatgctctgaaggaactggaaaaagaaattgggattacgattttttttagaagtggacgtggtgtaacactgacgaatgatggcgtggaatttttaacctatgccagagagctttatcatgagtatgaacagttactgcaccgttatacagaaggcagttcttataagaagaaattcgcagtttccacccagcattattcctttgcggtcaaagcgtttgtggacgttgcaaagacgctggatatgtcacagtatgaacttgcaatccgtgaaacaaagactgcagaagttattatggatgtcagcacaatgaaaagtgaaatcggggtattatatttaagtgactttaaccgcaaatccatggaaaaactcttaaactctgcaaatctggaatttcatcccttaattgagtgtgatgcttatgtttatttatggaagggacatccgttagcggaagaagcatgtattacgatgaagcagttagagaattatccatgtctggcatttgagcagggagacaacagttccttttatctttcagaagaattactgccgacaaatgaatacagtcagattattcatgcaaatgacagagcgacgatgctgaatttgatggtgggcttaaatggttatacgctttgttccggtctaatctgtgaagatttaaatggaaatgactatcgtgcagtaccgtttaaaaatagtgaaggaccggaagaaaacaaaatggaagtcggatatgtgacaagaaagaatctgattttaagtaaattaggtgagatgtacgtaaatgcattaaaagaatatctgaaaacggaataacgaaaggaatcatgaaatagccagttatagttttaaactataactggctattctttttgtgtattagacaggtggtttttgttatgttaatatcaatggcatgtaaaacatattaaacaggtatgaaaataggaatataaaaacaggaggaaaaacagatgacggatgttctgattattggaagtggtccggccggtatgacagcaggcatttacataaaaagagcaaacttagatgtgcagataatagaaaaagaatatgaaggaaccggtcagatggcagagagcagccgcattgataattatcctggattttatggaataagcggttatgacctgggagagaaaatcagggagcatgccgaaaatttagagattgaatttttagaagaagaagcagttgcctttgaagagaccaaaaaaggatttttggttatcctggaaagtggaaaaacactggaggcaaaaacagtgatttatacagccggagcagaacacagaaaattaaatgttcctggaagtgatacatttgaaaataaaggaatttcctattgtgcctcttgcgacggagctttttacaaagaaaaagacgtggtggtgattggtggaggaaacagtgcattggatgatgctttgttactttctgaaatttgtaacaaagtatatctggttcacagaagagataagtttcgaggcaatcctggaacacttgcaaaattagaagcaaaagagaatgttgaaattattcgaaatgcaaatgtccaggaaatcaaaggaacaaaaaaagtagaaactgttttgttagatacaggagcttcccttgaagtacaaggtgtgtttgtagcagtggggatgattccacagacagaaaaattaaaagacctggttgagttagatgaaaatggatatgtaaaagctggggaagatggaatgacttccaaaccgggattttttgtagcaggagatgtaagagcaaagaaacttcgacagattattacagcagcagcagatggagcaaacgcagcagattcagccattcattatatcatatagtagtacaacgtacgaatagaaaggaaacaatatcatggtaaatcaactgacaagagaaaattttgaaaaagtaataaaagaaaacagtattgttgttgtagagttctattctgcaacttgtaagcactgtaaaaagctggaggcaggaattgcagagctttccgaggaagccggaaatgaagtgtacttcggaaaagtattagtttctgatgaactggctctggcagacgaatatgaaatcacctcagttccgactttattatattttaaagacggagagattcgtgaaaaatcaattggctttacacataaactgattattgcagaaaacataaagaaattataaaagaacaggagtagatagattatgggatatccaagtatttttccaacaggaacattaatttatgataaagagaaaacatttaatggttatacgatttttccttccgcaaaaggagcattattaatcgatatgaatggtcgtgaagttcagctttgggcaggacttggcggatttccaaataaaattcttccaggcggatatgtaatgggaacaacaggaacaagacctggtaaaaaagcgtatcaggaccagattgatttggttcaggttgactgggatggaaatattgtctggaaatttgataaaacagaattgattgcagacggagataaagacccggtttacatggcaagacagcatcatgattatcaaagagaaggctctactgttggttattattatccgggcggagaaccaaagacagatagtggaaataccttaattttaacacatgaaaatctttacaatcatgatatttcagataaacgtctgattgatgacaagattatcgaagtagactgggaaggaaacatcttatggagctggagagcaagcgaccatttcgaccagttaggatttgatgaggcagcaaaaaatgcactgtttcgtaatccatgcctgcaaggtgaagccggtggtgactggatgcacatcaacagcatgtcagtcttaggtgaaaataaatggtacgaccagggagatgagcgtttccatccggacaacctgattattgatgcaagaaatgcaaatattctggcaatcatcagcaaagaaaccggagatatcgtatggcgtgtcggaccagattttaatgaaaacgaagcaaccaaaaaacttggctggattatcggacagcaccatttacatatgattccaaaaggacttccgggagaaggaaatctgctggtatttgacaatggtggagaaggcggatacggtactccaaaccctggagcattaacaggtgtcaacaatgcaaggagagattattcaagagtacttgaatttaacccgattacacttgagattgtatggcagtatactccacttgaagcaggaaatctgttatttacggatgcatctaaattttatagttcctacatcagtgcagcacagagacttccaaatggaaatactttaattacagaaggttctgacggacgtctcattgaagtgacaccggaacatgaaattgtatgggaatacattaatccatactttaataccatccttggacagtttacgaacaacatggtttaccgtgcataccgtgtaccttatgaatggattccacaggtagaaaaaccggaagaaatttctgttgaaccgattgatgtggaaaccttccgtgtgccgggttctttagttggaaatggacttggaaaagttaccacaatcgacggagtagacccagaagcacgcctgatgacaggtggcggagcctccgatgacgaagatgaagaagtgaacttctgtgtggcaaccgtaaagaaaagcgatttaattcataaataaatttaaggtcatgatacctgaaagggagtgaagaaaatgaaaagcaaaaaaattacagcagcagtttttggtcttgttcttacattaggtctggtggttacaggctgtggaagtaatagtagtaaagcagatgacggtgcgaagacggattcaggaagcaagaaagaagcaaatgcagatggatatcaggtagtcaatatcggtttcccgagtgccggttatgaatgggcagaaggtgcactggcaatagcagaagaaaaaggttatttggatgaatacttaaatccacttggatatgatgcagatttgattccatttacaggagctgcaccggcgattcatgaagctttggtatccggagatttggattatgcatattatgcaggatttgcaggaattatggcaaaatcaaatggaattgatacaaagttattggctgtaacaagctttggatctgcatggcagttagcggtcagcgcagattccggaatcacttccttagaggatttaaaaggaaagaccatttcctatcaaagaggtgcaactcctcagatgtatgtattaaaggtattagaagaagcaggtcttagtgcggatgatgtacagcttgtaaacagcacaattcctgaaggactttccagtctttctaccggtgcagttgatgcggcagttgttacttatggacaggcagataccttagtagaacagggaaaagcttctattattcataaaggggtagatgcagacgcagatacgttctatgaaccaagcgtgttaacaggaagaacagattttgtggaaaaaaatgcagatgtctcaagcgcaattattgaagctatgttaaaagcaagagatgatactattgcagacccggaagcattttacgaattgtcttctgaaaagagcggaagaacattagagcaggtgaaatctgtagccgtatctgatgtaaaacttgcttatccggtcagtctggatgaaagatatattacttcattaaaaaatattgagcagtttgaacttgataacgatattattaccagtcaggtagattttgattcctggattgattcctcctatctggaaaaggcagtgcaggactatcagggaaacgcacagtagggaggatacatgagcatgtacaaaggaaataacgtatttatacaaaaattattgctctttcttaatatgattatattgccggtactgattgtactggcatggcattttgccacttctaccggagcaatgtccacactgattctgccaaaaatcagtaccgtgcttgagacattgaaagaccagcttacaaatggtccgcttgccggagatatcggcattagtttaagccgtattgcaaaaggatatgcgctggcagttgtggtaggaattttacttggcgtgctcatgggaatgaacaaatttgcaaaccgttttttcatgctgacatttacagcgattcgtcaaattccaatgattgcatgggttccgattttaattatctggtttggtatcggagaagaatctaaagtagcagttatcttcttagccgcttatttcccggtactggtaaataccgtcagtggtattgaacgtacagacccgaaattgattgaagttggaaaaatgtatcatttaaatggatggcagcagtttacacagatttatcttccatctgctcttccttccatctttgtaggattaaaactgggattaagtgtatcctggatggcagtagtcggtgcagaaatgattgcagccacatctggtatcggattccgtatcaatgatgcaagaagcctgatgcagtatccgattgtatttgcaggaattatcgccattgcagtggttggtgtgattatggatttggccatctcactcattggtaagttatgcacaccttgggaaagaagcaggtaggaacatgggaaagaaaaagttaatcgttcatgatgtaaataaaagctttgtagttaatggacaaagcgtagatgtattaaaagatattaatcttgaaatagaagaaggcgaatttgtagtcatcgttggacacagtggatgtggaaaaagtacgttattgaaaatgattgcaggacttgagaaaaatgatacaggaattttaagtgtagatggaaaagaaatcgatggaccaggaatggacagaggaatgattttccaggaacatagattatttccatggatgagtatcgagaaaaatgtacagcttggtctaaaggggctgagcaaagaagaaaaaagaaaactttctgaccagtatctggagctggtaaagcttagtgaatttaaaaaagcatatccaagtcagctctcaggtggaatgtcacaaagagctgctattgcaaggtctttagtcagtcagccagaaattcttctcttagatgaaccatttggagcattggatgcgctgacaaagattgaacttcaggaagaaatgctcaagattcgagaacgctttcataataccatgattatggttacacatgatattgaagaagccgtatttctagcagaccgtatcgtggttatgtccgcaagaccgggacgaatcaaagatgtaatcaaggtagagcttggaaaatacagggaccgtggaagcacagacttcacacattataaaaagaaaatctttgattatttctttgaagaaaaaacagttacaccagaatacaatatttaaaaataaaccatgtagatgcctgagaaggatttacatggttttttgatttttggaaaaatgtgtaaaatcacgtcaaaaaagctggaaaaatgtgaaaaaaacaagaaaaaaattcggaaaaatgtgtaaaaatggatttgaaaagccggaaaaatgtattagcattaatatagaatgaatttaaaaggcggtggttttcaatgaaaagaaatgcaatgcaggatttagtacaatggaaaaacgatgaagaacggaaaccaatggtattaaagggagcaagacaggttggaaagacctggattatgaaagaatttggcaggcagtattatgagagttatgtatatttcaactttgatgaagaggaagagttaaaatccatttttgaaaccaataagaatccgtaccgcattattgaattgctatctataataattatttgattattgggggaatgccggaatgtgtagtttcctggataaaatataaagacccagccagagtttcgaggattcaaaaagagttaattgaagtttatgagaacgacttttcaaaacataatggaaaagtaaatagtggacggattctcatggtatttcgcagtattgtttctcagcttgcaaaatcaaatgaaaaattcatgtatagtgcagttcgtgagggtgcaagagcacgtgattttgaagaagcgattgaatggttagtatcagcaggtatggtgaatcgtatttataatgtgtctaaaatggagcatccactttcagcttttaatcgtttggaccagtttaaattatttgtattcgatacagggttattaaagtatatggcagggattgacaacagtgcgattttattaaattccagttatcagtttaaaggagcattgacggaaaattatatacttcagcagcttcatggtcagtttgaagttgaaccgcactatttttcttataagaatcaggagattgattttgtacttcagaatggaaattgttcctgttgaagtaaaaggcggtgaagataagtcagcgccgtcatttaaaaagtatgttcaggaaaaagaaccgaaaacagcgttgagattttcaaaaagaggatatcggaaagatggaaatgtcacgaatgtgccgttgtatctggcaaggaaaataagagagttgatgtgaaaagatgagtatgataatataaagtaaaatttggtgatgaaggtaggaattaaaaaatgtgttatctaattgctaaagacagagatgtgcatggatgcttcgcattaaaaacaaaacatggaaaacatttagcagaattaaaaagagaattaaatgaagcagttggctataaaggagttcagttagtaacaattagcagaccaacagcttatggagaatatgcaccgtattgttttgtggatacagagaaagagtttgaaactcttgtaaagtcattgcgttgatgaaaaatgtattaacgagaaaaccagccaatatacggctggttttttagtaaattattaaatggcaactttaaacattgctttctttattcgttctggtttctcaggagcaattcccgggcgatgagcatctgttggataacagataagaaaatcattctcttttaagaaaatcgttccatttgctgttccggagaacgtctcaaagtcatttgcctcgagatagttaagaggcttcatatttggtgtaaagttcacgtcgatttgttctgcaccttttaagatgaaatgaatatcaagaaatcttctatgagcttcccagcctttttcttctacagggacagtttcaaattccataatatttagatagacattatcgccatcaatttcgtaatgaccacagggaaaagaagcaaggtcgttattttttgcataatttaaacattttgcaatgccatctgcaaaatgagaaatatcgtttggtgtaaggttattaagattgtcgaaatacataaagagtccttctttcttttaaatttgtatgttatgctgttttaaagtattacgcaaaatagttgccatgatatcatagccttttccatttggatgaagaccatcataagtaatgccgtctaaaggaatactggcccccggatagcaggtaggggtatagtagttaacaaaaataagtccttcttgtcttgctttttgggtaagccagttattaaaatcttttataaaatcttttcgttccctttcatgtaaagaagttggcatgtaaattggcattaaagaagtaatgattaattgagtactggtttgttttgcctgatagataatgtcacagtaattttcttttgctttttcgagcacggcatcgtatggagcaggaggaattaatttccaataatctccctccaaattaattgtgtcattaattccgatgtccaaaatacaatatttcggttcaagctgtaaaacatcggtaaaaaaacgttttcttaaataagttgtgttgtctcccgcaattccccggttgataataaacaggttaggatttctgaaatatgcattgagttcccaaaaatgtgtaatggaatctcctgcaaaaatgaaatccggcttttgatttgagtacattaaagaatgatttttaatattaaattctttctggcggctgtcagcagccacaacttcagaatagtatccggcattgtgatttgacatatcagaacctccaaaagtaataatcttaagactgattatataatgaagaatcaatagaaaaaatggaatagacacttaataatagcataatgctgtcaaaaaacaatatttttgtattgattatagcttaggataagactatcatataagaggaggtgatttttttgaaacagggtgtggataatgtaaggtttaattttctttatgtggataaatattcttttggcagaacgtgggtctatccggagagtattgttccatacaatatgttaaggtatattcgctcgggtgcggctacattttttattgatgacaaggaaatatcggtagaaaagaatcagattatatatgttccgagaaattgtaaattgtcttgttatgcccaaacggataacttttcttttataagtatacgatttaccacatctgtattttttgaaggtggagattttctggcagattattacggagtaccattggtaacagaagcaaaaggcgaggaaaaatattttgacctgatttatgattatattaaaagtgaaaatccagccagaatttattttgtcagaggttatttggaaattttaattggaactttgatatccagagcagatgcagataactatggaatattaagaagaaacaagacggatgaggaatatactttggaaaaagtgagacagagaatccgtaaatcagataatcggattgattcgagaatacaggttgttgtagattatattgcacttcatcctacggaacactatacaccggagagtatggcaaagatggcggagttaagtaaacaaagatttagtcatttatttaaagagcaacttggaaaagcaccgatgacatatttaaaagagctacgtttaacaacagcggccagaaagcttttagtaacaaatgataatattagtgatatcgcatatagcgtggggtatgaagacccgaattattttacgagagaatttaaacacgcatttggatatacaccaaatcaataccgaaaagcagcgagagattagcatcaaagaatgagcgtattatgctattaatgcgacacgattgcggaaatgataagcttagtggagaaaaattgattaaaaaaaggcagtacagactagaaaaaacgtgactaatagaataaaaaacaactgaaacagcggagattgtagcaaaggtgatactttttaagcaggttgaaaagtaccaccttttaatgttgaaaaacgagcgtattgtgctattaataggttagagcttcattgaaaacgcctaaaaaaatacttataatgacaacataaacagcaatatgacgaaaaggacagagcatattgtaatggggctaggaaaaacaatttaaaaatcaccaaaatgagaagagtgaaaggagaacaatatgaaaaaaagactagcgatgctattggcgggagtaatgttgaccggcagtttattaacaggatgtggaggggattcatcagcgagtgatacaaactcagatgcaaaaaaagaagcatctaattcagatgaaactggagaattagagggcgacatcacattttggcattcctttacacaaggaccgagacttgagacaattcaaaaagcagctgataaatttatggaagaaaatccaaaagttaatattaaaattgaaacattttcatggaatgacttttatacaaaatggacaacaggtcttgcttccggaaatgtaccagatatgagtaccgcacttgttggacaggttgctgaaatgatcgattccgatgcaattattcctttaaatgatttgattgatgatattgggcgtgataaattccaggaaaatgcattaaatgaattaacagtagatggaaataattatgcagttccattatattcacatgcaatggtaatgtgggttagaaaagatttacttgaagcaaataatatggaagttccaacaacttgggatgagctgtatgaagatgcgaaggctttaacaaaagatggaatttatggattatctttcccatgtggaacaacagatttccaagcaacaaacttcttaaacttctatgttaagagtggaggcggaagccttttaacagatgatttaaaagctgacttgacaagtgatttagcaattgatggtattaattactggttaaaagtatacgaagactgttcaccgaaagattctattaactacgatgtattagaccaggcaaccttgtactatcagggaaaaacagcgtttgattttaactctggattccagattagcggtgttgaggcaaactcaccggatttattacagtatgtagactgctatccaattccaacaattaataaaggcgatgagcagaacggtattacaacttctaaccagccaatggttgtttggaaaaattcaaaacatcctgaaatttgtgaagcgtttattgaaacattatatgatgaagatacttatgttgaatttcttcatgcaacacctgtaggtatgttacctgcaattaaaggtatttctgatacagatgcgtataaagataatgacatgattaaacagtttgaacatgcagaatccgtaattgaaagtcagattccaggaggaacagcaattggatttgaacatggtccaagcactcaggctggcatcttaacaaatcagcatatcattgaaaagatgttccaggatattatcacaaacggaacagatgtagaagaagcagcgcaggcagcagaagatgaattaaatgctttatttgaagcagttcagtaagcatcgactgtattaacattataaagcaggaaatactttaaaattcctgctttataatttgaagagggtgaataaacaagatgaataaaaaaaattatactagatggctatttgtgcttcctgcgattatcattgttttggctttgtttgtatatccaattatatcaagcttttattttagttttacaaataagaatctgattcggcctacttatgattttgttggactcgataattatatagcagtattaaaagataaaggcttttggaatgcttttctcaattctttaaaatggacaattttttcacttggcggtcagttgcttgtaggatttacagcagctttggcacttaataaagtaaaacacttaaaaggtttttataaaacattattaattatcccatgggcgtttccatctattgttattgcgttttcatggcagtggattttaaatggggtatacggatttttaccgaacattcttgtacaacttggtctgtgtgatacgccgccacagtttttaacagatagagtgttggcgtttgtggttttagtatttattaatatttggtttggtgctccaatgattatggtaaatgttttagcagctttacagactgttccacaagaccagtatgaagcggcggaaatcgatggagcaaaaggatggcagtcattcttatatattaccgtccctcacattaaggttgtaactggattattagtagttcttagaacagtgtggattttcaataactttgatttgatttatctgattacaggtggcggacctgctggtgctactcagacagttccggtttatgcttatgatatgggatggggaacaaaattacttggaaaatcatcagcagtaacagtgctgttatttatattcctgatggctgtatgtgttgcttattttgcagttcttgcacattgggaaaaggaggataaatagatgaaacataaaggacaaaaaatacaaagctttatctgtcatttttatctgattattcttacgattattgcaattttcccattggtatggattatattatcttccataaaaggaaaaggtgagttaacaggaaatccaaccggatttttaccaaagacatttacattggaatatttcagacatgttatttttgacttgggattcattaataatattaaaaatagtgcaggaattgcacttgtaacaacattgattgcaattattgttgcagctttggcagcttatggtattgtaagattttttcctaaatttggaagtgtaatgtctaaagtgcttgtaacaacttatattttcccaccaattttattggcaattccatattcaattgttatggctaaggcagggttggtaaatacaagaattggtttgattattgtatatttatctttcagtattccatatgcggtatggcttcttgtgggattctttaaaagtgttccgattgggattgaagaagctgcaagaattgatggagcaaataaaattaaagtatttggaacagttgtacttccattggttgctcctggtattgtagcaaccgcaatttatacattcatcaatgcatggaatgaatttttgtattcattaattttgattaatgatacttctaagatgacagttggtgtggcacttcgttctttgaatggttcagagattcttgactggggagatatgatggcggcatctgtaattgtagtaatcccttcaatcattttcttctgtttaattcaaaacaagattgcaggtggcttaacagaaggttctgttaaataaaaaagaactaaaaacaacaatataaatcaaaaaaggagaagaaaaattatgaattacggtgtagttggagttggatattttggtgcagagctggcacgcattatgaaacagaatgaggatgcaaatattgtagctgtttatgacccagataatggaaagacaatcgcagaagaacttggatgtgatgcaacagagtctttgaatgaactggtaacaagagatgatattgattgtgttattgtagcaactccaaattatctgcataaagagccggttattgaggctgcaaaacatggaaaacatgttttctgtgaaaaaccaattgcattaagttatcaggattgtgatgaaatggttcgtacctgtgaagaaaataatgtaactttcatggcaggtcatgtaatgaatttcttcaatggcgtacatcatgcaaaagaattaattaaaaatggtgtgattggtgatgttttatactgccattctgcacgtaatggatgggaagatattcagccgagtgtttcatggaaaaaaattcgtgaaaaatctggagggcatttataccaccacattcacgaattagactgtgtacagtttattatgggagaaatgcctgaaacagtttatatgaacgcagataacgttgcacatagaggagaagcttttggtgatgaagatgatatgatttttattaacatgaagttttcaaatcatagatatgcagtattagaatggggttctgcattccactggccagagcattatctgttaattcagggaacaaaaggtgcaattaagctggatatgtttgatgcaggtggaactcttaaagtagatggaaaagaaacacatttcctgctgcacgaaagtcaggaagaagatgatgatagaacaagaatttatcatggaacagagatggacggagcaatccagtatggtaaaccaggtaaaaaacctccaatgtggttacatggtatcatggtaaaagaaatgaaatacttaaatgatattatgcatggaatggaaccagatgatgaattcagaccactgttaacaggagaagcagcgagagccgcaattgcaacagcagatgcttgcacaaaatcaagtgcagagggaagagttgtaaaggtaagtgaaattttgaataagtaatttaagatgatttttgactagtctaaagatgcaacaatagtgagcaagtaaattgagattcatattagaacatctttagactaaatttatattagatataaatctagaacatggaagaatgtttcaaaataaaaaatatgggtcgttaaattaaaacacggcagaatggagacaaatgaatagaaaattagtagcattatttttaagtcttgttatgagtatgtctacagccacagtttatgcagaacctacaaatgaagagacgcttcaaaaagaaaacattgagaatgtacaagaagataaaatatacaaaatggattggtatttgaacaaaataatattgatatagtgcagggacaagggtatgatgttagttctgaagaaggagcagagtatgtggaagccctatcggagggaacaattattatttctttcaaatcaaccagtcaaaatcaatatcagtcgttaatcagtataggaaacaatagaacgggaaatcaaaatagacattttcatctgtatataactaatacaggtgcagtaggaatggaattaagaaatacggattctgtatttaaatataccttaagtcgaccagcagctttgcgttctaaatataaaaatgagtatgtatcaaacactgttgcatttaaagctgatagagaaaatcatcaatataaattatttgcaaatggtgagttgcttgcaacattggacaaagaagattttaaatttataagtgatattacagaagtgaataatgtaatgttaggaggaacaaatagacaaggtacagtagcatatccgtttggtggaacgattaatagtgcgcagatatatcagagcgtattgagcgatgaagagttaaaagatattactggcgtcacaacttatggtaaaaatattttttatgaaggagacgctacaaattcaagctattttagaattccaaccatgcttactttaaaaaatggtcatgttgtaacttctattgatgtaagatatggaggaacacatgatgcaagaagtaatattgatattggattttcaaaaagtgtagatgcaggagaaacttggagtgaaccgactatgccaatgtgttttgacgactatgcagctgaacagattgactggccaagagattcagtaggaaaaaatgtccagataaatggaagtgcagcgtttattgattcaattcttatggaggatcaggagacaaatagactatttttatttgctgatgtagacccagctggaataggatttaataacagtagtgctggttcaggatttaaaacaattaataatgagaaatatgttgcattacgttggagcgaagataattctaatacttataattattctattagagatgatggagtgatttatgatgatacaacaaatcagccaacggaatattcagttgatggtaattataatatcttgaaaaatggagagtatttaacccaaaaacagtatcaagtaagatttgagggaactacattgattgaagaacataatgatgtggatgttaaacaaaatgtattctataaagattctgtttttaaagttaaacctgtcaattttgtaggaatgaagtacagtgatgacgagggtgaaacatggtcggatatgacattgttaggaaagtttaaaggggataatgaaagggttcctctttttggtccaggcgttggtgtacagataaaaaatggcgaacatgcaggcagacttattttaacaatgtataatagcaggtcggcagaattcggatttctctatagtgatgaccatggagcaaactgggaatattcgactacagatttaggtggaaacggaacatttgcagaagcgcagatagtagaacttccagatggaacattacaatcttatatgagaacaagtgtaggtaagataggagttataaccagtattgatggaggcacaacttggacaactcaatcgtatgtggatggaatgacagcagcatcgtatggaacacaattatctgtaataccgtattctggattagtagatggaaaaccagctattcttttatctgcaccaatggcaacaaatggaagaagaaatggtaagatatggataggtttaatcaatgatacaggaaaagaaggatatgataaatacgatattgaatggaaatattgctattctgtggacgatgacaaatatggattttcatatagttgtttatcagaaatgccagatggacaagttggaattttttatgaaaaatatgattcatggtcaagagatgaattgcatctgaaaaatattatgaagtttgaaaaatatacaattgatgagttaaaacaggaagttaagtaaataaagcaaaggagtttgtgatttggtaagtcacaaactcctattttggattaagtgttaaagaaaattatttatcaatcttactcagtgctgcttcatctgcaacgattgttacatcattatgtaactgcagaatagaagcaggaacttctggagtaattggcccgtaaagcacttcttttaagatgtctgctttatctgcaccacttacaacaacgaggattttctttgcctgcataatgtttttaatacccattgtataagcttgtttcggaacatcatcttcggattcaaagaagcgtttatttgcttcgattgtactttctgtcaagtctacgcagtgagtttctttttcaaatgcttcacctggttcattgaatccaatgtgtccgttatgtccaagaccaagaagttgtagatcaattggccctttttcctgaatgatttgattgtaatcattgcaggctttctgggaatccggttcaagtccgtttggtacaaaggtatgagtcttgtcaatgtttacgtggtcgaagagattggtattcatgaagtagcggtagctctggtcgttttctggacttaaacctttgtattcatccagattaatacttgttacctgtgaaaaatctaaatctcctttttcgtaccattcaatcaactgtctataagttccaactggtgaagaaccagttgccagtccaagtacacagtttggtttcatgatgatttgtgcggagataatatttgcagcttttctgctcatatcctgatagttttttgctttatagatattcatatctataccccttttcttttttgtaataattgtgtttttagctgtatttctgagtattagtataagaaatttcaggatgattttcaataaaatagggagaagttgggagtaaattagccattttggaacgataatcctattattgtacaaaattgctaaaaataaagcggtacaactaagagaaacatggataaaagtgaaaaactttgaaactaatttcataataaaacaactatattgaaaaaagtttcaaaaagaactatactttggacataacaaaggaggtcaaaaaaggatgaatcaaaaagtagaaaatctgaaaggaaaattaattgtatcttgtcaggcacttccacatgaaccgttacattcttcttttattatgggaagaatggcattggcagcgaaagagggcggagcaaaaggaatccgtgcaaatacaaaagaggatattaaagaaattcagtcacaggtagaccttccgattatcggtattgtaaagagagattatgatgacagtaaaatttacatcacacctacaatgaaagaaattgatgagttaatggaagtaaaaccggagattattgcaatggatgcaacgatttctacaagaccaggaaataaaacattagataaatttttccatgaggtgaaagaaaagtatccagaccagctttttatggcagattgttcaacggtagaagaagcacttcatgcagatgaacttggatttgattttattggtacgacaatggtaggttataccgaacagagtaagggtgataagattgaggcaaatgattttgaaattttaagaaaaattcttgcgagtgcaaaacacaaagtaatcgcagagggaaatattaatacacctgaaaaagcgagaagagtaatcgaactcggagcatatagtgttgtagttggttcgattatcacaagacctcagttgattacaaaatcatttgtagaagaaatggaacgataatatttataaattagagaatagaacaaaaaagcgaggagaaaaagctatgagaaatcttgaaaagtacaaaggtgtgattcctgcattttatgcatgctatgatgaagagggaaatgtaagtccagagggtgttcgtgcgttaacaaaatattttgtagaaaaaggcgtgaaaggtgtttacgtaaatggctcttcaggagaatgtatttatcagagtgtggaagacagaaaaattattctggaaaatgtaatgaaagcagcagagggaaaattgacagtcattgcacatgttgcctgcaataatacaaaagaaagtcaggaacttgcaaagcatgcagaaagtcttggagttgatgcaatcgcagcaatccctccaatttatttccacctgccggaatatgcaatcgcaaaatactggaatgatatcagcgaagctgctccaaatacagattttgtaatctataacattcctcagcttgcaggagttgccctgacacagtccttgtttacggagatgagaaaaaatccgcgtgtgattggtgtaaaaaactcctctatgccagttcaggatattcagatgtttaaagcagcaggcggagaagattatgttatctttaatggtccggatgaacaatttatgagtggacgtgtaattggagcagagggagcaatcggtggaacttatggagctatgccagaattatatttgaaactggatgaatatgtaaaagccggagaaatggaaaaggcaagagagcttcagtatgcatgcaatgaagtaatttacaaaatgtgttctgctcatggaaatatgtatgcagtgattaaagcaattttaaaaattaatgaaagtctggaacttggcggagtaagagagccactgccatcattaattgaagaagatatggaaattgtaaaaagagcagcgcagatgattcgtgatgcgaaagcaaaatatttataagtaaaatagttatttaagtagaaacacaatagaaaatacagaaaaaagagaaaggggcagaccgaaaagaaaggtttgtcccttttggggtatttggttataaagaagcggtaaaacggatggcttgagaaagtgtaagaaagtgtatataataaaaggaaagcataagaggaaaaaagagatgaaacagtacataagtattgatattggtggaacagcaattaaatatggtgtgattgatgaaaatgcacagattttaataaaaaaatctatggaaacagaagcctttaagggtggtcctgagattcttaagaaagcaattggaattgtagagaaattaatgaaggaaacaaaattagaaatttctggtatttgtatttcaacagcaggaatggtagatatcgaaaaaggttctattttctattcggctccattaattccgaattatgcgggaactcaatttaaagaagttctggaagaaaaatttaaaattccatgtgaagtggaaaatgatgtaaactgtgcaggacttgcagaatatcaatctggcgtagcaaagggaagccacgttgctgtgatgttgacaatcggaacaggaattggtggctgtatcattttagatggaaaaatctttcatggtttcagtaacagtgcgtgtgaagtaggttatatgcatctggatggcggagaatttcaggatttgggagcggccagtattttgacaaaaaaagttgccaaaagaaaacaggagtcagaatcagactggaatggatatcatatttttgagtcggcaaaacagggagacgaaacctgtattcaggcgattgatgaaatggcggatgtattgggaaagggaatttcaaatatttgttatgtactgaatccagaaattgttgtactgggaggcggaattatggcgcaggaagaatttcttggagaccgtattaagcaggcggtaaagaagtatctggtatcaagtattgaagtaaatacgacaattgcatttgcaaaacatcaaaataatgcgggaatgttaggggcgttttatcatttctgtggagtacataaaaaagaatagtgcataagaagaataggatgaagaaatgggatattatgtgaaatcagtagtgccggtaattgaatcgaattatgataagtttacgacagtagaaaaaacaatagcggatttttttattcaaaataaagagaaaagtgatttttcagtgaaggctgtttcagaacggctttttgtatcaaaggcttcgctggtgaggttcgcccagaaatgtggttatcatggctataaagaatttatttatcagtatgaagattcgttgatagaaaaacaggaatcaattaccggaaatacacgcatggtattaaatgcatatcaggaacttttgaataaaacatatagtcttgtagatgagacgcaggttggaagaattataatttatctaaaccaggcagagcgggtatttgtatgtggaaaaggaagttccggactttctgcgcgagagatggaactgcggtttatgagaattgggctgagaattgattcgctcacagatacagatatgatgagaatgcaggcggtctttcaggataaaaaaagtctggtagtaggattcagcatcagtggagagagggaagatgtgatttatttacttcgtgaagcttataaaaaaggagcaaaaacgattttgtttactgcaaaaagcaaggacagttttaagaaatactgttcggaagttgtgctgattccatctttacgacatttaaatcatggaaatgtgatttcaccgcagtttccaattttaatcattcttgatattatttatgcctattatatggaacaaaacaaacatgtaagagagggcatgcatgacagtacaattcgtgctttggaagaagcagaagagatgcatacaaaatttttggatgaagaataaaggagtaaaaaaccaatgctgattaagaatgtaaaagtctttacaaaagacaaaaaatttaaaaacggagcaattgccttatcaggtgacaaaatcaagacagtttacacagaagcaaacatgccggattcagacttggaggaaaccattgatggaaacggtgcttatgcgattccaggtttaattgatttacattttcatggatgtaagggtgatgatttctgtgatggaacaaaagaggcaattgcgagaattgcagagtatgaggcttctattggggtaactgcgattgcacctgcaactatgacacttccggtggaagaactggagcatattttagaggtggctgcagaatacaaaaaagaaaatacagacaagcgcagagctgatttacttggcattaatatggagggaccatttatcagtcctgccaaaaaaggtgcacaggatgaaagaaatattattccatgtgatgtggaagtttgcgagcggtttttaaaggcatcggatggtctggtaaaatttattggaattgcaccggaggagagcgaagaaacgattgattttatcaagtcagtaaaggggaaagtaaatgtctctcttgcgcataccaatgcagattataagacagcgaaagcagcatttgaagctggggcaaatcatgcggttcatctttataatgcaatgccgccgttttcacatcgtgcgccaggagtggtaggtgcggtctacgactgtaaacatgtaatgccggaaattatctgtgatggaatccatattcatccggcaacggttcgtgcgacattcgaaatgatgggagcagaccgtatgattttaatcagtgacagtatgcgtgcaaccggaatgccggatggtcagtatacactcggaggtttggacgtaaaggttgttggaaaactggcgactttggtatcggatggagcaattgccggctcagcaacaaatcttatggattgtatgagaacggtggtaaaagaaatgggaattccacttgaaacagctgttgcatgtgcgacaatgaatccggcgaagagccttggagtctgtgacgagtacggttccattacagagggcaaaaaagcaaatattgtgttacttgataaagatttggaattacaggcagttattaaagacgggatgaaattataatggagtttcgattagcgaaaaaacaggaatttgacagcgtcagagatttatattggatgttgattgatgagacttctcatctgccgtcttttccacactggaaaaaaggtctgcatccatcagatgagtggctgttagagagtcttgaaaaatctcagatgtttgtattagaagaaaatggggaaattcttgccagtgttatcttaaatagcaaggcaaatgaaagttatcgactggtaaactggagcagagaggttccggacgaaaaggttctgattattcatgtgcttgcggtttctccaaaacatgcaggcaaagggcttggcacaaagatgatgcagtatattttggattatgcaaaagaaatcaagatgcaggcagtacggctggacgtaatcagtaataacagttcggcggaacatttatatcagaaaatgggatttcggtttgtacagacacagaggctgtattatgaagtgactggagaaagagattttaatctgtatgaatattatttatagcggtcaactttttctgccaaaggattttgatgagccctgccgtggatgttgaagttgttttaagttttcgcataattctcttgaatttccacatactacccatacagtacaataatgggaaactaatagtatagtgaaaaatacaggaggaatgacacatgaaagcgacaggaattgtcaggcggattgatgacttaggaagagttgtagtgccaaaggaaatcagaagaactcttcggattaaggaaagtgatccactggagatttttacggaccgtgatggaaagattatcttaaagaaatattcaccaattggggaattgggagattttgcaaaagagtatgcacagagtctggcgcaggtttcgggatatacggtgtgtattgcagaccatgaccagataattgcagcaagtggaaagcgggcaaaagaatattcaggaaaattaattgatgaagaacttgaagtcgtaattttaaatcgtaaaacggtaaaacttgcgaaaaaagaagcagtcagattgacgcaaaacgatgtggcaggatatcagtcgcaggtgatttcagtaattacaagtcttggtgactgtgtcggagcagtgattattttcagcgaaaatggcgagacagaacttggcgagacagaaattaaacttgcaaaagcggcagcaggatttttaggaagacagatggagcaatagaatttcgtttgcgagattaaaaaaatggacatgacaaagcgaaaaaattgtcatgtccattctttatttcatgattttatattctattcgtttttaattgctgcctgactcatttcttcaagcaagtcacttttaattttatagagtttgtcggataaatccacatatacttcctgcggattaacgagacgcagagtttcgccccacaaggtctgtttttctttttgacagatgtcacgaatttccattacagatggggaagtatagacacattcgccttttttgaataccggaacaagcagttcacgtaaggtataagtgccaccttctatttttgtctttttccaggttgccatagggtcaaaaataatcatatctttttccgggtcaaagacttcatcggcaaggcagattaaatctgcgcggatttttccggttgctttgtcgtaaatacggaaaattgttttgtttccagggttggttactttttctacgttttcagagagtttgatttttggaatgaaatcttcatcttctttatttttgattgcagctaatttgtagacaccgccaaaagccggatgccctttagaggtaatcagatttgtaccaacaccccaggaattgacttttgcgccctgagcttttaagctgtcaatcagatattcgtcaaggtcactggaagcggagatgatagcatcttcaaatccggcttcttttaacattttatatgcctgtttggacagataagcaaggtcaccgctgtcaatacggattccatagccttttaattcaataccttctgcctgcatttctttaaagacgcggattgcatttggaacaccggatttcaagacgtcgtaagtgtcaacgagcaggatacaggcatccgggtataagttcgcataagctttaaatgcagtatattcatccggaaaactcataatccagctgtgagcgtgagttcctttgaccggaacatcaaacatctggccggttaaaacattggatgtgccgatacatccaccaatcattgcggctcttgcaccgtagattccggcatccggtccttgtgcacgacgcagaccaaattccataattccgtcaccttttgcagcatagacaacgcgggaagctttggttgcaattaaagactgatgatttaaaatatttaaaatggcagtttcaattaactgtgcttccataaccggggcaataactttaagtaaaggttctcttgggaaaataatagttccctctgggattgcatagatatcgccggtgaaatggaatcctcttaaatattccagaaaatcagtatcaaaaattttcagggattttaaataatcaatatcgtccggtgcaaaatgcaggtcacggatatattcaattacctgctccagtccggcacagattgcataaccgccatcgcacggattcttgcggtaaaatgcatcaaaaaccacgatttggtcagtgggatttttaaaatatccctgcatcatggtcaattcatataaatctgtaagtaatgttaaatttagggctctcataaattcttccttttccatacgttcttttgtgtctcaattatataacagatgaggggaataattcaaggagtttggcatagtaacacgctattttggtggaagatgaagtcctctttcataatattcttccaaagtcattccggtaagcgtaaggcttgaagcaagcccgattccggtatagcggatatgccatggctcaaatggaaaaccggtaatctcttctttgtttttaggataacgcaggatgaatccaaaaagagcacaatggcgggcaagccaacagccttctttggtttttgcaaaactttcttctaattcatagttttcatccgggcaggagatatcaagggcaagaccggtctgatgctcactgcatccaggcggagcaacaccggggcgtccatttgcagaagagaacagtgcttcctgtcttttataggagcgataaccggaaattccccataaatggatttcctctttttgggcgcgtttaaacagttcttctgcggcaatggcagcttcccgctgtaagaggcgacgtgggtcgttgcccggggcataaaaaggaatatcaggttcaattaaatcagaaggtatgtagtgagggttcagaggattttttttatttacaagaatagaaaaagaatacatgcaatgcctccatttcacaggaatagacttacatcattttatgcgaaatattcgagaaaaatcacacaaaaaaaatatttaaaaaaatttcaaaaaaagtgttgacttttttctgagtatcatatataattcattttgttgtaagacattgggctatcgccaaacggtaaggcaacggactctgactccgtcatttcaaggttcgaatccttgtagcccagctctcatatcccagacagaagtgtctgggatttttttttacagaaactaaacacttaaattagatttagatagagaaggagaatatatgaaatactcttttgacagttgtgtcagattcagtgaggtaggagaggatcagaaacttacgctcggttctgtgattaactattttcaggactgtagtacatttcagtcagagtcacttggagcaggagtcgaatttttaagaaaacagcatagagtatgggtgttgtcttcctggcaggtcgttattgaacgatatccggctttgtgtgagaaaatcaggataacaacctgggcttatggttttaagcgctttttgggaaatcgaaattttacaatggaagatgaagctggaaatgtggttgcctatgctaattccatctggacgtatttaaacacagaaacaggacttccggtggcagtttccaaagaacaggtagatgcctatggattagaagaaaaatttccgatggagtatgcaccgagaaagattgcagtaccggaaggcggaatggcatatgaactatttccggtacgttcccataacttagataccaaccatcatgtgaataatgaacagtatgtggcaatggcatgtgaatatctgccaaaagattttaaagtatggcagatgcgtgcagaatataaagggcaggctgtgcttgggaatatcatagagccgattgtttatacagatgaagaaaaatgcattgtatcactttgcaaagaaaccggagaaccgtatgcgattgtggagttaaaggagaaaaagagatgagattaggtgaaagacagaaactgattgtagtaaagaaagtagaatttggcgtctatctggctgaaagacaagatgcaggagaaaaggacagagtcctgcttccgattaaacaggttccggcaggaacaaaagagggagataaattagaagtctttttatataaagattcacaggatcgtctgattgcaaccatgcgtcagccgaaattaatgcttggagaaaccggatttttaagagtggctcaggtttcaagaatcggagcctttcttgactgggggctggaaaaagatttatttcttccatataaagagcagaccaagaaagtgcatgaaaatgaagaagtgctggtttctgtttatattgacaagagcagccgactttgtgcaaccatgaaagtatatcattatttacagacgaattctccttatacagaaggagatactgtaacgggaacggtttatgagagcagcgataactttggtgtctttattgccgttgacggaaaatattccggtatgattccaaggcaggaagcacaggggaattataaagcaggggaagaactgacctgccgtgtaacagcagtcagagaagacggaaagctgactttaagcggacgtcagaaagcacacatccagctttatgaggatgcagaaagtgtatatagtattattgaggactttgaaggggtgcttccgtttgatgacaaggcttcaccggaagtgattcaaagagaatttggtcttagcaaaaatgcgttcaaacgtgcagttggacatcttttaaaagagaaaaaaatagcaataaaagacggaaaaatttatcttctttaacgcttcacgaatgaaatcaaatatgttataataagcccgaaaatatcccatgtaggggagactacgaatactatgtttgtcattgtccaagaaggaggaaaataagtggactcgattgattattatgaccgatacgcggtaccttattatgaagaaactgttaatttaagcatggaggagcagttacaaagttttatggaattgctgccggaaaacggggaagtgcttgatttaggctgcgggtcgggaagagacaccttgtttctcgaggaagaaggtttcagtgttacggccatggatggttcaaagagaatgtgtgaactcgccgaaattcatacaggaagggatgttctgcatcttcgtgtagaggatatggaatttgatgatgtattccatggaatctgggcatgttccgtgctgggacactttgcgccaaataaaattcatgaagtgctggggaaaattctggatgccctgaaagatgatggaattctttatttttcggtgcgtaagggcgaaagaaagggaatgtacagcgggcgttattactgtgattatgacagagattccctggatgaccttttagattcttttgataatattgaaatcattgatatatggaaaacaagtgatgcaagaggagacgaacaaagtaagtggtacaatgtgcttcttagaaaaatcagtaaagagaaagaataaaaacgtgtagttagttgatgtactctcgaaatcaagtacaaaaagatttcaagagcacatagttggaaaaaaggagaatgacagtgaattttactcatttgcatgtacatacagagtacagcctgttagacggttccaacaagataaatgaatatgtgtccagagtaaaagaactgggaatgaaaagtgcagccataactgaccatggggtcatgtttggttgcattgatttttataaggcggcaaaagctgccggcattaaaccaatccttggatgtgaggtttatgttgctcctggttcacgctttgacaaagaaaaaggaaaagaagaggaccgttattatcatctggtgctgcttgcggaaacgcaggagggatatcagaatctgattaaaattgtatcttacgggtttgtggatggattttattataaaccgcgtgtggatatggaattgttagaacaatatcatgaaggaattattgcattaagtgcctgccttgcaggagaggttgcaagaaatcttgcaagaggattttacgaagaaggaaaggaagcagcactcagatacgaaaaaattttcggaaagggaaatttctttctggagctgcaggatcatggaattccggaacagaggcaggtcaatcatgaattgattcgaatgagtcgtgaaaccggaattgaactggtggcaacaaatgacgttcattatacctacagttccgatgctgaggcgcatgatattctgctttgtgtacagaccggaaaatcgttaaaagatgaaaatcgtatgaggtatgagggtggacagtattatgtcaaatcagaagaagagatgagacgattgtttccttatgcacccgaagcgattgagaataccggaaaaattgcagagcgatgcaatgtggaaattgaatttggtgtgacgaaacttccaaaattcgatgtgccggatggatatactgcatgggagtatttgaacaaattgtgctttgaggggcttgataagcgttataccgataataaggaagaactcaaaaagcgtctgaattatgaacttggtgtcatcaaagacatgggttatgtagattactttttgattgtgtgggatttcatccgttatgcacgggaacaaggaatcatggtaggaccagggcgaggctcggcagcgggaagtctggtttcttatacacttggaatcacgaagcttgacccgattaaatatgatttgctgttcgaacgttttttgaatccggagcgagtgtccatgccggatatcgatgtggatttctgttttgaacgacgccaggaagtcattgactatgtggttgaaaagtatggaaaagaccaggtagttcagattgttacttttggtacgatggcggcaagaggtgttatcaaagacgttggaagagttatggatgttccttatgtgcagtgtgatacgattgcgaaaatgattccgcaggaactaaatattacgattgataaagcaatgaaggcaaatccggaattaaagaaaatttatgagacggatgagacggttcgcaaactcattgacatgagccggaggctggagggactgccgaggcatacctccatgcatgcagccggtgtcgtaatcagccagaaaccggttatggaatatgttccattatcaagaggttcagatggttcgctggttacgcagtttacaatgacaacactcgaagaacttggtttgcttaaaatggattttcttgggcttcgtacgttgacagtgattcaaaatgcagaaaaactggttcggcgggataaaggaattgagcttgatatggacaagatcgactacgaagataaaaaagtctatggaatgcttggagcaggaaaaacagaaggggtgttccagttagaaagcacaggtatgaaaaacttcatgaaagagttaaaacctggaaatcttgaagatattattgcgggattgtcgttataccgtccgggaccgatggatttcattccacagtatattaagggaaaaaataatccggatgaaatccactatgactgccctgaattagagccgattttaaaggcaacatacgggtgtatcgtttatcaggaacaggttatgcaaatcgtacgttcacttggaggatatacccttgggcgaagtgatttggtgcgtcgtgccatgagtaagaagaaagcatccgtcatggaaaaagaacgccagaatttcgtgtacggaaacgaagaagagggagttccggggtgtattcatcgtggaatcagtgaaaaaacagcaaataaaatttacgatgacatgattgattttgccaagtatgcgtttaacaagtcacatgctgcggcttatgcagtggtttcttaccagactgcattcttaaaatattattatccggtagaatatatggctgcgcttatgacttccgtgattcataatccgtctaaagttgcagagtatattttatcaagcagaaaaatgcagattgaaattctgcctccggatattaattttggagagagtgaattttcagcagaccatggagcaatccgctatgggttatccgcaatcaagagtctcggagcaccgatgattcgtgcgattgtggaagaaagaaaagaaaatggaaaatatcagtcacttcgggattttattgagcggatgagtggaaaagaactgaataaaagagcaattgaaaatctgattaaagcaggagcacttgaccaggttgcaggaaaccgtcgtcaaaagctgatggtctatgcggaaattgtggatgcagttaatcaggaaaagaaaaatgcaatgaccggtcagatgagtctgtttgatttgatttcggatgaagaaaaagaagcttatgagattcagatgccaaaagttgaggaatattccaaagaagaactgctttcctttgaaaaagaagtgcttggtgtgtatataagcggtcatcctctggaagaatatgaagagagatggagaaaaaatattacagcacggacagttgattttcagatagacgaagaattgggaacttcaaaagcaggagatggagaaatagcagtcataggcggaattatcacaaataagactgtaaagtatacaagaaacaataaagtgatggcatttcttaccattgaagatttggtgggaacggtggaagtcgttgtttttccgaatgattatgaaaaaaatgttcaaaagatggaggaagattccaaagtatttatccgaggaaaagttcagggtgatgcagataaggcaagtaaattaatttgtgaaaaaatttattcgtttgacgatgtaccaaaagaactctgggttcagtttgagacaaaagagaactatcttacagaggaaaatgagttcctgaaacttctgtcaggttctcgcggaacagaccgagttattatttatgtacgcactccaaaatcgattaaatatttaggaattgaaaaatccgtgaaaattaacgaaacactgttgggtaagttgtacgaaaaatacggcatggacaacgtgaaagttgtagaaaagagtattgaaaatattacaaaaatgcattaaaattaagtacgattagaggtcaaagaggaaacgtatatattaatactttatggaggaagaaaatgactgcaaaaaaagaaattaagacaatcggtgttttaaccagcggtggagatgctccaggaatgaatgctgcaattcgtgcagtagtaagaagaggattaagtaaaggaatcaagatgaaaggtatcctgaaaggatacaatggtttattaaatgaagaaatcattgatatgactgctgttgatgtatctgataccattcagaaaggtggtacaatcctttatacagcacgttgtgcagaatttcgtacagaagaaggacagaaaagaggtgcggaaatttgcaaaaaacacggcattgacgggcttgtagtcattggcggtgacggttcttttgcaggtgcacagaaactggcaaacttaggaatcaacaccgttggtgttcctggaacaattgacctggatattgcatgtactgagtacacaattggttttgatacagctgttaatacagcaatggaagcaattgataaagtacgtgatacatcaacatcacatgagcgtgtaagtattatcgaagtaatgggaagaaatgccggatatatcgcattatggtgtggcattgctaacggtgcagaagatattctgcttccggaaaaatatgattatgatgaacagaagattatcaacaacattattgaaaatcgtaaaaaaggtaaaaaacatcatatcatcatcaatgcagaaggtatcggccattcacaggctatggcaaaacgtattgaagctgcaactggtattgaaacaagagcaaccattcttggtcacatgcagcgtggtggaagcccgacttgtaaagaccgtgtatatgcatctacaatgggcgcattagcagtagacgttctgcttgaaggaaaaacaaaacgagtaatcggttataaaaatggtgaatatgttgattttgatatcaatgaagctctggcaatgcagaaatccattccggaatatcagtatgaaatcagctattctctgtcacataactacagcaaaaatgactaattaataaaaagtataaaatataaaatgaggctgttgcactgatatacacagcctcgtttttaatttagttatggagaaaataaaatgataacaagtatgtcaaatggacagatgaagctggtgcagcagttgataaaaaaagcgaaagcccgtaaagaatctggtctttttgtcgttgaaggaatgaaaatgtttcgggaagcaccacaggagagaattgaaaaagtgtatgcttcctcttcttttctgaaagaagcagaaaatcagagtgtaattctggaaaaaggctgcacagaaaagaatggaaaattagaagaggtagatgacaaagtatttaaaaatctgtcagatacagtgactccgcagggaattttgtgtttgattaaaagggtggaaactccgatcaaagaaattttaaaaacaaaagatgaaaaagccccatttcttatgattctggaagacttgcaggatcccggaaatatgggaacaattcttagaacagcagaaggcgcaggggtaacaggaattattttgagtaaaaattgcgtggatttatataatccaaaagtaatccgttctacaatgggttccatttaccggatgcctgtgatgcaggcagatttgcttgaaattcttccggttttaaaagaaaataaaatacagacttatgcagcacatttaaaaggaaaaaactggtaccatgaggaagactatacagagggaactgcatttttcattggaaatgagggaaatggtctaagcgatgaattatcagattcagcggactgtctgattaaaattccgatggaaggaaaagtggaatccttaaatgcggcgatggcagcaggaatcctgatgtatgagactgcgaggcagagaagaaccggtagataagtctaccggttatcaattttttctggatataaatcatgctgtgtcaatctctggaaagcaacctgttcccataaagtgccggcttttccatagttgcagtaagggtcaatggaaattcctccacgtggagtgaactttccccacacttcaatgtatttcgggtccatgagccgaatcaaatctttcataataatattcatacaatcttcgtgaaaatccccatgatttcggaaactatataaatacaatttcaaagatttactttctaccatacgttctcccggaacataagaaatgtaaatcgtagcaaaatccggctgaccggtaatcgggcataagctggtaaattccggacaattgaattttacaaaataatcattttccggatgtttgtttgggaaggtttctaacacttctggtgcataatcatctttataaacagtttttttgtttccgagcaggcttaaagttccaagctcgtcttttgttcttgtactcatatcaacgacaatctcctttatataaaatgtatcagttacctcaattaggaaataataaaagtatatcaaaatgcagtacctcttacaagagaaccttagaaaaatgtaaaaatttacaaaatattacaaaaaacaccgtattgacattgaaaagtaatcttgatacaataactttgtaataaaaattaataaatttgtaataaattcaagcaaagtaatcataaggcttgataaaacgcagaaatttcaggaggtaattatgaaagaaagaatgcgccatattttatgttgtataggaacggttggtttgatgatgacaatgggggcagtgcctgccatggcagatactttagatgatgcatcttataactgggacgataaggtggctgcgaatgtagttacatacgctaatattcgcgaaagtgcagatgcagatagtagctgcgttggacggcttccatcgggagcggttgcaaccgtagtcggaacggaaaatggctgggtagagatttgttccggagaagtagagggatatattcgtgaggatttactgttatatcaggacgatgcaaagaatttatacgaagcactgcatggaacaggcgatgttgttacggcagaggcggtaacacaggaagagattcaggaaacagaggaaattcaggaagaaattcaggaaacggcagcagtagagacagatgcttctgcttcaaaccaagatttggatttgatggctgcaattattgaatgtgaagcaggtggggaatcttatgaaggaaaaatcggagttggagcagttattttaaatcgaatcagaagcagtgaatttccaaataccctttcagaagtaatttatcagagtgggcaatttgagccggtctggacaggaaaattagcaagtgtactttcaagaggagcaaatgcagactgctatgcggcagcccgtgatgtctttgcaggagcaaatacaattggtgaatgtctcttcttccatgcgggtggtggaagtggacttactattggaaatcagacattttattaaactttgttaagaattaatacaaaactaatatacaagttgttagaatcagtcttttacgatataatatcctaaagggctgattttttatttcatagaaaattttgttctatgaaataggcaaaataaacaagaaaggaatgtgaggaagatggcaatactatcagcaggcatgatttctcttggttggctgatactgcttgggattctcctaatcattgagattatcacgctggggcttacgactatatggtttgcaggaggagcattaattgcatttcttgtggcgattttaggcggtgcagtctggcttcaggttgtggtatttctggcagtatcaattttgcttttgctgtttaccagaccaattgcaatgaagtacatgaacaaaaatgtacagaaaaccaatgtggacagtctgaaaggggaaaaagcagtggtcattcaaaccatagataacttaaaaggaacaggacaggttgtcatccgtggaatggaatggtctgcaaaagcaagagaagataagattataaaagaaggaactgtagtaaaagtcattactgtagaaggcgtaaaagccgtagttgaggaggaaaaataatatgccgattattttattagcagtcattattttactggcacttatggttgcagcatcctgtgtaagaattgttccgcaggcgcatgcaatgattattgaacgactgggaatgtataaagagacctggtccaccggtcttcattttaaactgccattttttgaccggattgcaaagagagtgaatttaaaagaacaggtagtggattttgcaccacagccggttatcacaaaggataatgttacaatgcggattgatacggttgtgtttttccagattacagacccgagactgtttgcttatggagtggaaaatccgattatggcgattgaaaacctgacggctacaacgcttcgtaacattatcggtgatatggaactggatgcaacgctgacttcaagagaaattattaataccaagatgagagcatctcttgatgtggcaaccgacccgtggggaattaaagtaaaccgtgtggaattaaaaaacattattccgccgtctgcaattcaggaagcaatggagaaacagatgaaagcggaacgtgaacgtcgtgaagcaattctgattgcagaaggacagaaaaaatctacgattctggtagcagaaggtaaaaaagcatctgcaatattggatgcagaagcagaaaaacaggctgcaatcttacgtgcagaagcagaaaaagaaaaaatgataaaagaagcagaaggtaaagcagaggcaattttaaaagtacagcaggcaactgccgatggtatccgctttatcaaagaagcaggagcagatgaaagtgtattgaccttaaagagtctcgaagcgtttggaaaagcagcagacggaaaggcaacgaagattattattccatctgagattcagggcattgcaggacttgcagcttctttaaaagaaattgtaacagatgacaaaaagcaggaaaaataaaattcaacttaaatagtgtttgagtaaaatcaaaaatagaaagattcaagtgcgtgcaggcgtacttgaatcttttggatttatttaaccaaatcaagtaagttccctgcttcaattgcgaaaagcaataagcaggggtggggacttgcttgtatcaggaggggggggcaagccccttctgataaactgcgtagcagctatttggttatgagcaagtagcgaagcggattgcgaatatccacttgacattttcgactaacaaagggcaggtgatttgtaatatgaaaccagtaatcgatttagagaaagaatacggtcttgtattagaaggtggaggcgcaaagggggcataccagattggtgcgtggagagccttaaaagaagccggtgtgaagataaaaggtgtagccggaaccagtgtaggtgcattaaatggtgcacttatctgtatggatgactatgaaaatgcaaagaaagtctgggaaaatatcacatattcaaaaatcatgtcagttaaagatgaacaaatgcagaaactgtttcgcgaaaagaaagcggatataacgatgttgaaggatgcttttaatctgatgaaagaaggcggaatcgatgtgactccgcttcgggaattaattgcagaatgtattgacgaggaaaaaattttaaactctccgattgacttatatgtactcacatttgatgtggatgaatggaaagaactggatattaatatgaaagagtgtgaagatccatcgatgataaaagattttttgcttgcaagtgcctatatttttccattatttaaaaatgaaaaattacatggaaaaacttatattgacggaggggcaattaataatgtaccgcttggctcccttgtggaacgtggttataaagatattatcatgatacggatttttggtgtaggaagagaaaagaaagtaaagataccggaagatacaaatatttatacggtagcaccaaaagtcagccttggaagtattattgaatttgactcaagaaaaaccagaacacatttaaaacttggatattatgatactctgcgtatgatttatggattgaaaggaaaaatttattatattgatgaatcggaagaagagtgttattatttaaatcagctagtaaagcttaatgcagagaattatcggcacatcatgacggcatataaactgtcgcaggctgaaagccggtattgccgaaatatgacagaggttgtactgccggttatagcagaggaactgaaactttcaaaggattggacctataaagaactctatcttgcggttcttgaggcaactgcgaaattatgcagaatcagtaagtataaagtatatacggtagatgaactgcgagaaaagatacaggaaaaactgcatgggctttcaggccgtgaattgcctgcatttgtatggattgttgcaaaagaaattccagaagagatatccagcacagatgaataaaaaggatgagaaataaagaaatcggaggataagaacatggatttaaaaggacgtaattttttaactttaaaagatttcacaaaagaggaaattgaatattttattaatttagcagcagattataaagaaaagaaaaaacagggtgttgcagtcgataccttaaaaggaaaaaacgttgctctgatttttgaaaaaacaagtacaagaacacgttgttcttttgaagtggcagcacatgatctgggaatgggaactacttacctggatccgaaaggttcccagattggaaagaaagaaagcattcgtgacaccgcaagagtacttggaagaatttatgatggaatcgaatatcgtggatttggtcaggaaatcgtggaagaacttgcaaaatatgcaggtgtaccggtatggaatggtctgacaaatgaatatcatccaactcagatgttagcagacttgttaacaattcgcgaacaccttggaagagtagaaggtgtgaaattagtatacatgggtgatgcccgttataacatgggaaattctctgatgattctgtgtgcaaaaatgggcatgaactttgttgcatgtgcaccgaaaaaatacttcccgaatgaggcactggtaaaagaatgtgaagcatttgcaaaagaatccggtgcgaccattactctgacagaagatgtaaaagaaggaacaaaaggtgcggatgttatttatacagacgtatgggtatctatgggagagccggacgaagtatgggaagaacgtattaaagaattatctccatataaagtgacaaaagaagtaatggaaaatgcaggaagtcaggcaattttccttcactgcctgccggcattccatgatctggaaacaacgatcggtaaagagatgggagaacgctttggcatcaaagatatggaagtaacagatgaggtatttgaatctgaacagtctgttgtctttgatgaagcagaaaaccgtatgcatacaattaaagcagtgatggcagctactttaggagcataaaaaatggaattaaaagcaaaatggatggggattccatggaactggacagaagaaatggattccacaaatgaatgggcgaagagggacgcaaaaaatggcgctccctctggcgctgtttatatagcagacagccagacacagggaaaaggcagaatcggaagaagatgggagacgccaaagggaagcagtcttgcgctgtctcttttactgcgccctgattttgaagcagaacatgcaccgatgctgactttagttatgggaatggcagcgtgcatggcaattgagaaaattaccggtcttacagccgagattaaatggccaaatgatgtggtaattaataagaaaaagacaaccggaattttgacagaaatgggaatgtctgagggaaaaatttcttatgtggtagttgggattggaatcaacttaaatatggaatcctttccggaagagcttgcgtataaagcaacgtcattaaagatagagtgcggacacgaaatcaacagagatgaaatagcggctgcgcttttattttattttgaacagtattatgaaaaatttgaacagactcataatcttggatttttaatagaagaatacaacaatcatctggtgaaccgcggaaaagaagtcctgattaaagaagaagatggagaatacacgggaatcagtcgtggaattaatgacaaaggagaacttctggttgagaaaaaagatggaaactgtgtggaaatcttttcaggagaagtttccgtccgtggtttgtatggatatgtgtaatgaattgtaagttggaaaataaattggaatcagggaatgagtcaggaaaggaaagcaacaaagagtatgtataaagataaaattgtgctgtgcggggcaagtgcttatgaacagaaatattattttaatgaagattttaaggcacttccacaatccgttcaggatgaactgcatattatgtgtgtcatgtataccacagaaatcggaggtgtgctgactcttgaatttgatgaagagggagagctgcagtttcgtgtagaagcactggaagccgatgccatgtttgatgaaatcggaagtgcgcttcggattaaacagatccgaaaagaaaaacaggaattattagaagcattggaactttactatcgtgtattctttcttggagaagatgtttctctggacgaggaatagagagtccaatttattggggcaagatagaatggtttaaagggcaatggcatataatattttgaaaaacagaggttaacagtgaagctgagtattggaaatgtaacacttgaaaataatttaatactcgcacctatggcaggagtaacagacctgccatttcgtttgctttgcaaagaacagggagcgggacttttatgcacagaaatggtaagtgcaaaagccattcattttaaaaataaaaatacagaaagtctgatgcggattttacccgaagagcgtccggtgtcgcttcagttattcggctcagatgcggatttgatggcagaaatcgcagcacagattgaagaacgtccatttgatattttagatattaatatgggatgtccggtgccaaaagtagtaaacaatcaggaaggttcagcactgatgaaaaatccaaaattggtgggtgagattgtaagcaaggtttcaaaagcaatcaaaaagccattgaccgttaagataagaaaaggatttacagaaaaaagtgtcaatgccgtagagattgcaaagattgtggaagatgcaggagcttctgcaattgcagttcatggaagaaccagagaacagtattatgcaggagtagcagactgggaaattatccgacaggtaaaagaggcagtttctattccggtcattggaaatggagatgtcgattcaccggaacgtgcaaaggcattagttgaacagaccggatgcgatgggattatgattggacgggcttcaagaggaaatccctggattttttcaagaattcagacctatcttgaaaccggagagataccgccacagccgagtgcagaagaagtaagagaaatgattttaagacatgccagacttcagattgaatataaaggagaatataccggtatgcgtgaaatgcgaaaacacgttgcatggtatacagctggtatgcctcattcggcggcagtaagaagagaagtcaatgaagtagagacgtatgagcagttagagcggctggttaaagacagattggaatcttgacatttttactcatttcatttataatattgggactgttgagaagattatgacaaaattttaaattcattataaaatcaaaaataactgagaaaggatgttttatcatggaagcaaagaaaaacatactgacctatgcaggtcttaaaaaactggaagaagaactgcatgatttaaaggtaaataaaagaaaagaaatcgctggaaaaattaaagaagccagagagcagggtgacttatccgagaatgcggaatatgatgcagcaaaagatgaacagcgtgatattgaagcacgtatcgaagaaatcgaaaaaatcttaaaaaatgcagaagttgtagtagaagatgaagttgacttagacactatcagcgttggatgtaaggtaaaagtttatgatgtagaatttgatgaagaaatcgaattcaaaatcgtaggttctactgaagcaaatagccttgaaggaaaaatttccaacgaagcgccggtaggaaaagcattaatcggagcaaaaaaaggtgataccgtacaagttgaaatgccatccggaattatcgagtacaaagttctggagattgaaagaaatatctaaagattaaggagagtgtgaagaagtggcagaacagaataagaacgcacaggaacaggacctgaacaagctgttaaaggttcgtcgcgaaaaattagcagaattgcaggaaaacgggaaagacccgtttcagattgtaaaatatgatgcaactcatcatagccaggaaattaaagatgcatttgatgaattagaaggaaaatctgtatccgtagcaggacgtattatgtccaaacgtgttatgggtaaagcttctttttgcaatattcaggatttaaaaggaaatatccagtcttatgttgcaagagacaacattggtgaagaatcttataaagattttaaaaagatggatatcggtgatatcgttggaattaaaggtgaagttttcaaaacaaaaaccggagaaatttcaattcatgccactgcagtcacactgctttccaagagtcttcaggtacttccggagaaattccacggactgactaacacagacctgcgttaccgtcagagatatgtggatttaattatgaatccggaagtaaaagatacttttgtaaaacgttctaaaatcatcagcacaatccgcagatacttagatggacagggatttatggaagtagaaacacctatgcttgtagcaaatgccggtggtgctgctgcaagaccatttatcacacattctaatgcacttggagaagacttcaaactgcgtatttctcttgaattatacttaaagagactgattgtaggtggtctggaacgagtatatgaaatcggacgtgtattccgtaacgaaggtgttgatacccgccataatccggaatttacactgatggagttatatcaggcatatacagattacaacggaatgatggatttaacagaaaatctgtatcgttatgttgcacaggaagtacttggaacaactaaaattgtatacaatggcgtagaaatggacctcggaaagcctttcgagagaattaccatgttagatgctgttaagaaatattcaggtgttgactttaacgaaattcatacacaggaagaagcaagagcagcagcagacgcacatcatgtagaatacgaagaaagacataaaaaaggtgatatcttaaacctgttctttgaagaatttgtagaagaacatctgattcagccgacattcgttatggatcatccaatcgaaatctctccgttgacaaagaaaaaaccagagaatccagattatgtagaacgttttgaattcttcatgaacggatgggaaatggcaaatgcttactctgaattaaatgacccgattgaccagagagaacgtttcaaagctcaggaagaactgctggcacagggcgatgatgaagccaacacaacagatgaagactttatgaatgcgctggaaatcggtatgcctccgacaggtggtatcggatttggtattgaccgtatgtgcatgattctgacagactctgcagcgattcgtgacgtattattattcccaacaatgaagtcacagggtgctgctaagaacgaagcaaacaatgcagcacaggaaacaaagccagttgagaagattgatttttccaaagtaaaagttgagccattattcgaagaaatggttgattttgatactttcagcaagtcagatttcagagctgtaaaggtaaaagcatgtgaagcagttaagaaatccaagaagctgttacagttcactctggacgatggaacaggcacagatcgtaccattttaagcggtattcacgcttattatgagccagaagaactggttggaaaaacactgatcgctatcacaaacctgccgccaagagctatgatgggaattgattcctgtggaatgttacttagtgcaatccatgaggaagagggcgaagaaaaacttcatcttctgatggttgatgacagaatcccagcaggtgcaaagctctattaagatgagaaaactgagccttgcggcggtgtgcgcttgcgaacaccgacataaggcgaaaaacacacggagacgtcagtcgacgtgatgtaaagatgtaccgttttaccaaataaacgggacgtacttcatttgataaaaaactaaaaaaacagcgatttacatcaaacttacattaattgatgcagaaatcggtgcaagcaagaaaaaatcgcataattagtgcaatgagtgggcaattccaatcggagttgcccatttttaaaacaaacagaaatacaaatcgggatttaacgcttgagaaaagaggagtaaacatggcaaagaaagaagaaagatttgaagttacatttagagacggaagtgggcttaaagatgaaggaattcgtcaaattcttgtagataaggagactggggttaactacctttgttggaactccggatttggagccagtattacacctcttctggattcggaaggaaaagtcatagtcacaaagtaaaattcttgtttgaaaaattgagaaaacgtaatattgaacaaaaaagaaatgcacagttcttagcttattgtgaactgtgcatttttgtaaataaatacttttaattagccgattacggcatcctctgctgtaaaatgttccagagaattttcttttacctgaatgcagatataagtaattccagaaatatcggatgcaaaaaactgacgctttgcagcaggtgcgatttttagccagtctccagttgaaaggctaatttcttctccatcaattatggctctgccgttacctgaaagaattccatagatttcttcattttctttatgagaatgaacaaatggaacatttgctcctgcaggtagttcgtttaaactgatttctgcacctgttaaagacaacttttcatgtagctcaattcggttttcctttccaatagttgtttttgtgtaatttgccataatagtacctccatagttaatttgtagtttctggttgcttggtattagtatagtgtgagacacatacaaaaacaagtacgcacctttttgtaactgtacactcaaaaatgaatgtgttacaatagactcggaggtgagaattatgcgagcaaaagaagaattaccggaatgcccagttgcaacagcagtatctcttatcggaggaaaatggaaactgctgattttgcgtaacttgaaagagcgtccatggagattcaatgagctacaacgaagtatagatggtatttcacaaaaggttttgacagatagtttaagacaaatgatgagtgatgggctagcatatcgccacgattaccatgagcagccaccgagagttgaatacggcttaacggaactcggaacaaaaatgcttccaattgttaattcacttgctgactttggtaactactataaatcaattattgatgttgtatcataaaagttgacaccacattctcaaggattttgatataatcataatcaatacgagaacaggagaaaaacattatggcacgaaatcaaagaacctatgacaacgaatacaaagcacaggcagttaagcttgctcaggaaatgggtggagctaaagcagctaaagaactgggcataccagatggcacgatttactgctgggtaaaagcatttaaagaaggacgccttagcgcttcagaagcatcccatactcctaaaaatgctttatcacttaatgatgagcttatcgagctcagaaaacgtgtgaaagagcaggataaggaaatccgccgtttaaaggaagaaaatgaatttcttgaggaagcaagtgcttttttcgcagccagccgtcggaagtcagcaaaaaacagagagtaatgtttattgcaagcaaaacggatgacggcaggatcaagggtaaaatttctttttattgcagagcacttcatgtttccagacaggcattcaataaatatctaaaaacaaaagcgactccttggaaatatcagccgttggcagatgcgatggttgctatttgccgcgaagatgaatgcaatgatacatatggaaggatccgtatgtatcaggcgttacagctcaaatagccagaaggagtagacattcctagtgagagaacggtttatcgtgtcatggaagaaattggtcttactcataaaccgaagcgtaagccgaacggtattactaaagcggataaaggagctcggaaatcagatgatttaattaagcgggacttttcagctgagagacctctcgaaaagtgtattacagatatgactgaaataaaggcttccgatggaaaactgtatgtttcagctatctttgactgctacgatttagcagtattaggtctggctatggatacgaatatgaaagctgccctttgtgaacaaaccttagataatgcctataaagcatatccgatgctccggggtgccattcttcacagcgacagaggtacacagtatactagcgagttgtaccgtaacgcaatcaataaatatggcattcttcaaagtatgaacagtgccggtggcagatgccatgacaatgcaagatgtgaaagtatgtgggcacgattcaaagaagaattactttatggacgctacgacgccaccttgatgactgtagaacagttaaaaactcttatttggagatattttatcagttattggaataatcggaggatctgctctgctaatggtggactacctccgatggttaagcggcaacaatactatacttcactacaagaggcagcataaggtcgaacatccttgtgaaaaaagtgtaaaccaatattgacaatatcattaatattgcactacctgtaaaggagtatagagaggatggattggataaaaaattaacagaaaaaattactgtttcagatatagggtatcttgatgtaaattgtgattttaggaagtacaagggtatattagaaaaaataaaagagtatatcaatagtattcaaatatttatgaatcaagtgcctttttatggcgattatatgatggaactgatagatgtttgtaactgtgtaatcaaaacatataatgcgcttatggaaggtaattaccagaatagtgaacttgtttttagttatttggaattgctctatgaccatgcaagtttactatatgcaaatcgtgatttgaagattcaggagtgtattgatagaacagaagaacgccataggcaagccatagatgaagataaaataaaagaacagtttgaggaatttcattaattaatggatcaaatactacataagcatgaggcgttccattttgattttgaaaatcagggaaattatgaaaatatataatttggtttccgatgggtgggagcctataagatttctgcagatgaattgttagatggaaaagaaggaaaagcaacagaaacaaagctggagagagggataaagctgatccgggaacttcttgctgataaaaaagaaatttcaatccgggaattagatgaaaaagcaaaggaacaaggaatttctggaagaaccatgcgtgatgtaagaaaccggatgaagaatgagttggagtatcaagtaaatgaaaagcaggaaaacagtattcggttaaaagaatgatgggtggcagagtcattgaagcaaatataaattttttcggagatgttaagcagcatatagaaggtgaaaaaggtatagatgattggaaaatgctctctgatattgcaagctttaaaaaggaatatatgcaagaaaattatcgtaatgctagacagattacagcatactgcaataaacgatttaagcttaatatgtgtgcaatcaatttggatgggactggagttcatgaaattacaagtgcgagcgcttttgaagaggcgttttctggaattttccaaaaacctcagaatgttggtttgagttgtattattgttaagaatccatcagaagcagatgaactactggcaaagtatgaaatgtatatatctaggattcatgatataacaaaagaatcggtcgaattacagagaacaaaatagaatctgatgatggtcgaacaatctaaaggtcttgaattcgaaactgtatttgcagttaccggtcgaatgagcgaaaatgaaaagtacattacctatacaagagctttgaacgaattgtatgtgtatgatgaagagataaaacttagcgtgatttctataaaaactggaactaatgagaaagctgacaagaaaactaaagaaaaaagtagccgtaagaagcgagaaaagagaagttctaaggaaacagctgatgctgatttagagctataaatataatgaatctgaaatcaaaatgtgtaggaactatatttttaggcatgaaaatggaaacggaggcagtgaaatagatatatcaaaagtagactggaaactttatcgtgaacgtgtctcagactggcaagaacattatatggaaaaactaacagaagaatatgtaaaattactaacttctcccggcaacgcatcagatcatttctgggaactggaaaaaagaattaagcgggacaagaaacatcccgggattttaattgagcttcgcaaatctactgctatatgggatattgcatattttgtaagggataaggtgattacaatggatgaactggaaggattcagtgaggacttgattgatgcagtaaagttgattttaagtaggtaattgttaaacggataataaagttgaaaagggatggtatgaatatgagggatgctataacactaaattattataatagcaatgctgctgttttttctgaagctacaaagaatgtagatttttcggaagttcagcaaatattcataaagcatctctccacggatgcttctattttggattttggttgtggatccggacgtgatacgaagtattttctggatcagggctatcatgtaaccgaaacagatggctcagaagagatatgtaaaatggcgactgagtatacaggcatccaagtaaaacagatactgtttgaagagtttgcaaggcagatttctggactacagatagaaaaaatgtggattaccggagctgtgagagaaggaagaggtgacgagaggtggttggatatattgcttcgcaaggcagacatttgctgaatattgaggcaaaatattataataaactggatatcgaggctttctctcagatgatgaaagatccctcttattgctacaagttttattggttggaggccgtggtacatatcgtttcaggaggaaagaatgagacaacatttgatgagattattgatgaaatgattgcgaatgcctggtattcagtacgggaatttcatattcaccttagtggaatacaggcagatggattggtcagagatggtctggaaagggcaattttacagctgacagaactcagtgatcttccggcaaatgcatctaagatcgaaataaagaatgctattcggaaacatcagacagatttaaagaaagtaaaagaacagttgactaatatggtgccatatagagcactggcaggcttttttacaaagagtaatgaagtaccggactggggaagtgtcaaacgcattacggcgtacattcaaaaggtaaatgaactggtaacacctttgccatatgtattgggtgaaagcagtaaattaaaaaaagaggtgcattttcatccagactgggcagcaatgatccaggacaatacagtcaatattcttggctggattcaatatgaaaaagtgaaatggcttcaaaataataaccctgaagtgcctggtttgatttataagcttactccagtggatgaaaaaatgcgaaagctgtcaaatgtgcggaagttgtggcagggaattatggaagtacaggaaataagggatgttttcacaggacagttagtaaaagaaaaacagtatgatatagatcatttcattccatggtcttttgtaatgaatgatgagttgtggaatctgatgccgatggattcttccttgaattcctcaaaaagcaatcgattacccaagtggaatccattttttgaagttttttctggaaaccagtatctgatgtatgaaatgataaatgaaaaaccagaacttcataaacgatttgaagcatgttatcgggataatctgcattctatctgggctggtcaggaattgtaccgtaaaggtaattccagagaagtattttataacattctggaaaagaatatgatgccgatatatgattcggccagaagacaaggatatgagatctggaactatgggtagaaggagagcacaatacaatgaaattattgggcttatctcggaaagaaaaagaaacttgaacctccattgtaatccaaggaattaagccgaatatgcaggttgatgacgttcttttgaagaatgctacagaaagtcatattagccagcatattcgaattttggaagaaagtgttcgtcttgtgttagaatctaaaaataaaaaaacaagagaagataggtatgagttggtattacaacattttagcgcattgtcaaaaatccggaagtatgccgataaaaatcagaaaaaaagaattgcggatgcacaggattatttcatgattatgaatgaacactataaacatccagaacgtatcagaaagcaggaaaagcaaaaattgaaaagacagaaacgagattcgttttatgaaacatggaatcatcaggattctttgcctgtttatattgcaggaagttatgattttcacacagcatatattggaaacagacgctgtataatgtttgctccaacagaagaacttgacacacttccggcattgaaaaaacaaattgcaaaaatacagcaaattgataatgtgccagttgtatttgaacttgcgacagtatctaattatcgaagaaaaagccttatagaaaataatataccgtttattactgataagcaggtctttcttccttttattgggacaatgctttttgatgaaaaagacccacaaaagctgacgggtaagtttgtttactccacgcagcagttgtttttattttatactacgattttacaatcacagtcaaaggagtgggggtacaggctttcattaagagaaaaaaagaagaagtattttgtttacgaatatctgtttgaagagaatcctatattaagcgtgaaacggtttgatgctttgagcgaagaatggctggaatttattaaagacaaccgaagtaaaggcggattacaacacaactatgatgtagtaattggaccggttgcagatgataatacaatggagactgttcaactatatatagcgaatattttgacagcatcagaagcagtggaaagattacggtataataaagtaaataatcaggtatcatttcacacagagaaagcgttacagtatttacagttggtaaggaggacttcttatgccagaaatgatttatagttttaatggaaaagatatcactatgaatgtatgcatacaaattagagatgtattaaaattattgcaacaacattatcaaatcagtttcgaggaagcagcattgaaattttataaatccgaaacgtataagacattgcaggaaacagaaaatggattatgggcagaatcggcagaatatatagctgacaggtattatgaagaagccgaaagtaatccagttgccgtttaaggagtggttgatatgtgcaagacgatgcaggtacgagaggctattacacaaaaataagaaaatcagttttgtaccaatcatgtaccaatctgtaaaaaatatcgtagagatataaaaaataagacctattgtggagccattatccacgataggtctttcatattcgagccattaaaaattttttctacatttttttatgtatgtctgaatcagggtgaagcatatgcaccggaagaaatacggagaaagtctgtctgtataaatgaagatatcggagaaattctgaaggaactgtagacttgacagacagattcgatcgaagtattagaataaaattgtataataacggtaagagaaaaaagtaattaaaataattggttttcgagtagcacaattatattagaaacactgacttttaacggttggtgtttcttttttgcactttttgagttcatctgacattctctgctttcccacgtgtgattaccggaaaaataaatttttctaattatataaagtgttgcgactatctttgatgtctgtacgagggtatggggaatcggaatccccatcaagagacttacccggaggtatgccgtagccataaaatggcgatacggtaatacttgggtggatcttgctcttaatctacaaaccctcttacatatacaaaagatggagaagtaaaatacagggtgtgagagaaaagaattttagaaaaatttaaaataactcaaaaacttgatttttaacattgcctaagttaaaatgaaagaaaataagttaaaaggagaacgagaaatatgcttacaagcgtattcgggatttctataaaatatgaagcatggaatcatcaggattcgttgcctgtctatattgcaggaagttataatttttacacagcacatattggaaacagacgctgtataatgcttgctccaacagaagaacttgccacacttccggcattgaaaaaacaaattgtaaaaatacagcagattgataatgtaccagtcgtatttgaacttgcgacagtatctaattatcgaagaaaaagtcttatagaaaataatataccgtttattactgataagcaggtctttcttccttttattggaacaatgctcatggatgagaatgaacccgtaaagcgaattgaaaaatttgtttattccacgcaacagttgttcttgttttatctgtacagtaagaaaaagcgattgtatatttcagaagccggaagagtgcttccatttacagcaatgaccttgaccagagcagtaaagcagttggaagcgacggatttatttcttgtagcaaaagacggtgtcaataagtttattgagtcaaaatataagcgagatgaattatttgaaaaagcgaaagtatatttgacgactcctgttcgaaaaacaggatatatagataagacgcaagttacagaaaatatggtctttgcaggggaaacggcactttctgaaaaaacaatgctaaatccaagtcgagttgttacctatgcaattagtgagaaagattatgataaaaccttgctgactaatgaattgatagacccggataaacaggtaagacttgaattatgggcatacaacccgaaacaattttcagaggataacagtgctgatgatatttccattgttttgtcttttacagatacaaatgacgagagaattgaagaagctgtagatgaattgcaggaaagaaggttgaaggagtaatggtcagagtcttgtcgatttccggactataattctgccataagcttcagaaaaagaaaaagcttacattgaaaatgattttgtgataaactggaattcgaattgtcaattttgcagtgtgacggaatgttttacactgtatttatttttgaattttaggaagaagaggaacaaaatatgccaataggagtgataattaatgccttgtcaattgctgtcggcggtgtgattggggcattattcgggcataaattgcctacgaagcttaactcggagcttaccaagatttttggtatttgttcaatgggaatgggtgtcagttccattgggcttatgaaaaatatgcctgccgtcatttttgcagtgattattgggactgcttttggtttggctgtcaatttgggagaaattattaacaatggggcagcttgcatggagaaaccggtgggaaaactttttccaaataaaaataaatcaatgtccagggaagaatatatgtcgatgcttgtaacaatcattgtgttgttttgtgccagtggaacaggaatctatggagcattggactctggaatgagcggtgatcatacaattttgatttctaagtcaattctggattttttcactgcgatgatttttggaggaactttaggcatggtgattgctgtggttgcaattccgcagtgcgtgatttttttggtaatctttgtagcagcgaaatttattttcccactgactacgccggatatgattgcagactttaaggcatgcggcggttttttgcttcttgctactggttttcgaattgcaaaaattcacgattttccagttgcagatatgattccggctatggtgcttgtgatgccggtgagttggttctgggtgaatgtgatagtaccgctgctataaggtggtagggtaaaaattgagcaaagatttaaaattaagtagaaatttaaaatgagttgagatttagaataagcagacacaattgtgcagaaagacagttaaaagtaagaaaataaaacaaataaatagaacctgctcaggcacatatttgcttgagcaggttctattttattttaaaaagtttcttatctaggccatctgcctttcttatccatcaacggtgcaaacgcctgatgtggttcactctggtaccaataagcaacacttgcaacatcatcctgtcgttcaaacaggcctttataacatactccaatctgctgaatcgtaacttttaaatcttcttcaaagcaaatcggatccatcaaatgccagcgataaaagcctcgcatcggtgggcagtcatcattatgataaggattatgcacgagttcatcatgtgcggaataataagggtatcccaaaaatggagaattataagtttgttctaccgtctttccgtttacctgatgtgcaaagctccaggagccaccaaaatagtcctcggttccggtaccacagatagttggatattcgtcatctccatcaatataaaatttaacttcgccttctccccaccaatatctctcaagtgttgtcaaagcaagataggtaccaacataatgaccttttccttttacattgtccagaatcacataatcctttgcaagttcggtaattctttggcgtctccactgtgcatgaaaataagcggtatcttccggtaactcatcgtataaacagtaatctacttgatagaagaacgcaggaattggattatcatgctgattttctaaagtgatttttgcttttttacggaatggcatttcaaaatagctgttaaagcctctgtttggaacgacagagattggcatagaagttacaagacattctcttgcaaaaccgcagcagaagaagtcacctaaaggactttcgaccgatggagtttcctcatcgtcccagtacatgcgaagcactaaatcgcgaagtacataacaatcggcatctgatgttttattatcaaccgtaatccagatatgctggataatacccggtccatccatttcggctaatataaccgtttcatttggcataatatcttttaaacatggacttccttttctggaaggaccaagatggcttgctgccatcccgccctttcctttttcaccagttggattttctgcatttatcgctctggatcttccgttttttaatctaaaaatatctgacattatcgattcctccgtttattgttttacaccgcctgccatgacaccttccataatctgtttttcaaagattaatacaaagataacgattggtaacaggataacacatccaacggtactaatcaaatcccatggcatactgtatgaggtttctcttgggattgttgtaattgcaacactgagtacttctattttttgtgcaaaaaacaatggtgtaaacaaatcgttaaggcagttgataaagttaatgattaagatggttgcaattgcaggtttcattaaaggcagcgtgatatagaacagtttctggaacatattcgcaccatcaatctctgcagcctcatccattgaaactggaatttcacttaaaaagttacctaaaattaacatggtaaacggaattaacgcacttgtgtacatgataaccagtcctgggaaggtatcgattaatccaaactgtttcattaagtcgtataatggtcttgcggttacgattcccggaatcaaagcagaagccacgattgcagcgtatacaagtgtaagtccttttccggaataacgagtaaatgcataagcggacattaaacagattacagtggataagattaatgagcacacggtaataattgcagtatttaaaatcttttcgcccagattcatttgtgtaaagatccggatatagttatctagtgttgggtgcttcggtatatagtgaattggggaactaaacaattcatctgccggcgaaatagatgatgtaaaaatccaaagtaatggaagtaaaataataaaggcaacgatcaagattaaaatccatttgaatacggatgccaaaattcttttgttttttggtttcattttccacatctccttctatatttaatcaaatttctttatcgccttaagctggataaagcttaaaatagtcataacgataaacaagcaaaccgcgattgcagatgcatatccaagatttaagtttgtaaaggcttcctgcataattcgatatgctaacagtgaggttgaatctccaggacctcctgaggtcatcgcatatactaagtcaaaacttgtcaatcgccacatagtaaagaagatagaaagacttaatattgttttcataatgtttggcaatgtgatggaaaagaaggaacggattggtccggctccatcaatttttgctgcttcataaatgtcggctgataaaaactgcagtgcagcaagtactaaaattgcgaagaatggtaaatctttccataagtcaactgcgataactgcgccctgtgcagaatttgcatgcacaagccagtcaaagtgaaagtccggaacaaatttgcggattagatcattgattaatccgtatgcgtcgttgaatgcccatcttgcagcaagtccggctactaccattggcattgcccatggaatcagtacaatagtacgtaagaattttttacctttaatcttcatatttaacattaatgcaagaattacgccgagtatcagatggaagaacatggatactaccgtaaatattacagtaaatcgaatagaagataacaatttttgatcgctaaagattttaatatagtttcctaatccgataaactgaaagtcagttccttttaacaagctcatgtcataagtgctgttgataaaggtcataatgattggataaagtgttgtagatgctcgtacaatcactaccggaagcaccagaagccatgcgatccatagtccctttgtcttctttttcattgctatttacctcctgtgaaatctctgagatacgatatgaacgactttattttacgacataagtatcaacagattgctgtgcctttttacaaaattcatcgagtgttaattcatcagatacatactgctggaataaagaacccatatcactgatgaattccattgcctgaggagccataggacgcgcaagcagttcagtatctgctacgtattctctgatttcatccaaacctggcagatccattgcagctaactcatcgctttccaatacatcggttcttgccggcagtctggaagtcatttcggtgtaatccagctcgccctgttcactagctgcgtatttaaggaacttctctgcggctgctttatttttggaagcactgttcaggacatatccccatgtagacatataagcggttttgttctcaaatgttggcataggtgcaatgtgctgtttatccgcaccatattttccggaattaacaaaagtctggattgcacctacgtacatgaaaatcgaagcgtagtcgccatcaaagaatttctgcatcattgggtcatactgatcggcaagctgagaaatcggagtttcattattcttcatcatgtcgtacatgaattttaccgcttcctgcgttttcggattagtccaatcatagtaatctccaccaaataagtttacaaacgttccgattgagttaaatacataagttttttcccatgcatcgccatatccgtatttgccgtctgctgagtttgcttctacatatttctcgaagtcttcttttgttttaatctcagtaagacctgcgtttgccatcttttcttcatctacccagaaagcaagaatatccataaagcaaggaacagaataagcattatcgccaaccattgtcatttctttcatatatttctccgggaagttcttcataacttccggtgtcatgaccgtatcctgaagtggctctaagtatccggtgtttttaaatgcactcatcatttcatcattgattgtaatcacgtcgatgctgtcatcgcctgaggaaaggatggttgtgattttggcctgacggtcgtctgtgttggttggacacgcaattgtttcgatttccagaccggttgcttcttcggctttctggatatattcatcaaatgcttttccataagtggtgtcctgtgtcattaaagtgattttgttggaattttcattttgcttggcttctgagcttcctcctgattttccgcagccgctacaaaggccaacgagcatggttgctgtgagtaatacactaacgatttttttcttcattttcttttacctccaatgtttaatatgtactttcgaaattcttctgtcactgatttttgttgacttaatcataaaaaaatacaggtcaaaaataaatatatttttttatgcatgatttatattatttttcgtttttgatgtaaatgattgtattttttagtttttttgattagaattaggctggaaggagtgatacatatatgcagtttgctaaaagattaatcaataccatcaaagaacattttcgcttaaagctactcatttgctttattctctgtgcgatttttcccctttttgtattgggaacgatttcttacaaaatttcttacaatatagcaaaagacaacatgctaaaagaaaccaaaatagcgtgtgaaaaaaatcaaaatctgcttgaaaatcgaatgactcagatagagagcttagcagattcgattcattttaatttatgtgtgttatgcacaaccccggaacagccgatgtcaaaatatcttgataccctttcctcggtgcgaaacaatattacttcgatggcggattcatttaatatttatcatgtaaatgtttttctgccggaggacagttttgtgtcaaatgaaggaatcacgttttgttctttatcggaaatggaagattatagagtacagttaagtgattttgccaatcagggaattaaaccgaagtggctgtttcagaaacgagtgaagtttccatatatggtaagtaaaaacaaaaatcccgtaggcgtactttcatgctatcggtctgcccaaattaattcgcaacaatattgttttgcacttcatataacgagcgatgaattaagctactatttggacgaattttcaaaagagaatccttctgtttcttacataatagatgcggagggaaccatcttagcaagtacggatcagacacaaatcggtacgtctttgactaatgaaaaacggaatgcgcttacccaaaatagaaagacgtctcatatttcatataatgaatgtgaaatcatttcagcaccggtacacaaccagctgtttttgattactgagacaccggattactatattcgtcaaagtgcatcgcttcttgtaaaaatgattttcgtgtgttttataattgtggttccgttgacgatgtttgcaattatctgggtagcggatcaaatgacaaataaagtaaatcgtttgtcacattctatgtctgagcttaagatggacaacgtcatagatgcaacacagattaatgagttggttccggcaacttcttctcatttagatgaaattgatacgctgacggttacttgtgctaacatgattacagagttaaatgcgagctttgaaagtaatctaaatttaaaaatacaagaagaaaaattgaactatcagttgctgcagtcacaaattaatcctcattttttatataatattttggcatctgtgcagaatttattgtcattgggggaaattagcaaagcagataaaatgcttgctgatttatcacggttttacagagggctgttgcgcacctcaaatgatttgattccgattaaaaaagaactggaaatcgcatgtttgtacatggagatggaggcattatgtaaagataatttgtttgattgggatatagagctggaagaaggaatcgaaaactttcttatttgtaaatttacgttacagccgattttggaaaattcgattcagcatggtttaaaaggcaatggaatccatatgcatatccatatttctatcacctatgatgatgatatgattgaaattataatttcggatgatggaatggggatgtctcctgaaaaattaaatgaaattcaggaaagcattgaatccaaacagattcattatgagaagcattttggtatcagcaatatcaattcgcgaatctgttcttccttgcaaggtcatggtacacttaaagtagagagcaataaagattcaggaacaacgattcatatcagaattccgcagttactggaggattagtaatgtacaaaattatgattatagatgacaatcatatctcggttgatgggatttgtcataatattgactggtctgatttaaatgcagaagttgtttgtaaagcgtatgatgggcagcaggcacttaattatttgcagaataatttggtggatttgattatttcggacattgaaatgccacagttagatggtttatcgcttgccgaaaatgcactgaaactgaattcctctataaaaattatcctgatcagtgcatttgataaatttgaatatgccaaacaagcgatacggctgggagcatttgattatatagagaagccacttgattatgcttatctggaagaaatcattcgtaatgcgcttgatatgctcgataaagagcagaagaatcttgcaatcttaaaaaagagtcgtccaatcatggttgacaattttttccataaattaatacaatcttcaagcgatgaagcgcgatatacactctcagattatgcaaattatcttcaattaaacttggaatatcattactatcaggcgattgtcattcgaatacaaaacgcagtagaaatcaaagaaaaaaacggaattgaagagtatcatataaagttaatgagcatgtcggatacgataagagaactttttgataaaaactttgctttggtgcatactttgtcaacttttgatgaaatcgtgttgctgcttgggcataattattcaaattcaaagtacttctacagtacgtcatatggattgttgacagagttaatacagatgtataagcatcatctttttgaagtaaatattggaattggcagcattgttaaatatttgtggtcgttgtcgtcttcgtattcaaatgcattaaaatcactggaatatcgttttttctttccacagaaagatatctttacaatcagtgatacagtagacaaagattatgctgtagagctatatgaggtttccggaaatgaagaactgatacagctgttgtgtaaaaatgatttggatggagtaaaaaaatggattctctcattttcagaagaattgacgcaaagctataaaaacaaacaatttatctttttgcgtgtctatcagcttttggggcatttactgaaatttctttgtgacatggggcttaacatcaatgatatggaaaaagatattattaagacgtaccaacagcttgatgcgttctcgacaagtacagaaattttccaatggctgtttcgcttgtgtcagacaatttctgatgaaatgaacctttcaacgaaaagccatcaagagcatgtttgtgctgcaacgttggagtatatacagcagcattatcaggataacacattatgtttgaacgaaattgcggaaaatgtacatatcagtccggcgcaccttagtgcgctatttaaaaagcagcgccagcaaaatatttcggatgtaattgcagacattcggattgaagcagcgtgtagtttattaaaaaataccagtcttccattgaaagagataagtgcgaaagtaggctattcaaaccaatattactttagttcttgtttcaaaaagaagaccggtaaaacaccttcttcgtacagataaaaaataatcggctgctttctgtattattttcaggaagcagccgatagctttctactcggagattattctttttattcggttttgaaacaaaaaagttcaaattctaaagttcgtgtagctacagcattatagagcagctgctttttgaattcgatattccgtaggtgtcactccataatattttttaaattgcttacaaaaataatcaaccgtttcaaatccaacgttttcagcgataacaattacttttttctttgttgtagtcaaaagaattgctgcttcctgcaatcgatattttagcaaataatgcaccggcgtatcatgaagatatttgtgaaacaagtttaacgccgtgcttttgcttaccatggcctgttcggcaatctcttctaaagaaagtttttggttaaaattttggtgaatgtattgcatcataagttgcagtcggccttgtgatgaaacaatatttacttgtttttcttttgataaatcttcttttatatgggagtaaatcagataccaaagttcttgtacaagacaagaggtgagcagctccatttcgccttcttctatttggagtgatattatttttttcataacatgtaaagcttctttttgccaggggatttccggtgaaaaaaacaaacaatctaatgctgattttttaatgggttcaatgtacttttgataaattcggctgtttgaagctgcaataaatgttggaagcaggagaaaatttggaatgacggctcctttttcagaataaaagcgatgaagaattccggaattaacccagaatccttgtccttcagttatggaaaactgtttttctcctgcccaaaatatagcatttcctttttcaacaaacacaaattcgaattcgttatgccagtgccattcgatacaattaaaatcaaataaagacagattgtcataataaaagtgaaatggataatcgctacgaccatgctgaattgtttccatcatattttcatctgtcaaaattttattgtagtaggtgttataatccatgttttttctccgtatttcttctccataatttttgaatttacgatattatacaataaatatctgatatattccagtgaaaaaagagtgagattgtgttattgtacagtagacgtttttgtgaaaaagaacgtagaataaaaaaataagcagaaaggaaattttttaatgaaaagcaagtatagaaaaacattaattgcctgctatttaggattcatcactcaggcaatcactgcaaactttgtgccgctgttgtttttgatgtttcacaggacttatcagatttcacttggtaagattgcttttatttcaacagtgttcttttttacacagttgcttgtggatttgttttgtgcaaagtatgtagataaaattggatatcgcagaagtgttgttgcatctgaagtattgtccggagtaggtttgattgggctggctgttttaccggagctgctgccttctccttatgttggaattttagtcagtgttatgatttatgcaattggaagtgggcttattgaagtacttggtagtccaattgtagaagcatgtccgtttgataataaagagagtgttatgagtcttttgcactcattttattgttggggttcagttggagtaatcttgctctctactttattctttgcaatttttggaattgaaaattggaaaattcttgcatgtatttgggcagtgattccattgtataatatctttaattttctttcttgtccgattgaatctttgacggaagaaggagaaggtatgagtatcagccaattattccaaatccctattttttggatcgcaattattcttatgatttgtgccggagcaagtgaaatttctatggcacagtgggcatctgcttatgcagaatccgcacttaatattccaaagagtcttggagatattgtaggaccgtgtctgtttgcagtcatgatgggagttagtcgttcattttatggaaaatacggtgaaaaattagatttgataaaatttatgattggttcaggagtgctttgtcttgtttgctatttgcttgcagcattaggtccatttccgattttaaatcttgcaggttgtatcgtatgtggcttttcagtcggaattatgtggccgggaacaattagtattacttccggtaaaattccgcttggaggaactgccatgtttgcattacttgcgatggcaggtgatttgggtggatccatcgggcctggtgtgattggggttgtgactcagaatgcaaatgataacttgaaagccggcatgttggctgcctgcgtctttccggtagttctgattttatcggttctttttattagaaaaaagagagctgaaattaagccaataaatcaaaaaacagaatcttttttatgagataaagtttgaggtgctcgcaaaaagcggcacctctttttgcgttatattattttgttttgacaggattctgaattcatttgatataattacgaaaacagactatacttaggataataaggtttgcgtttgcaagataaataagccaaagcggaggaggaaaacagtgtcaactacccacctcccaagggaagtgggggttcgcttatgataaacgaaaggatgtcatgcggcttgtggtattttgcaaatgtctatagatacccatggtagaaaggaaacgtttatggagcatttgcgttgtgtagtagagcgaattacatatcaaaatacagagaatggctacacagttttgaaatgtgctgtgaaaaattataatgaccttgtaactgtggttggcacaatgccggatactcatgttggttccgtattatcgctcgacggtatgtggaagatggatgccaaatatggacggcagttttctgtacagaaatttgaagaaacccttcctgcaaccgtatatggaatagaaaaatatctgggttctggtttagttaaaggtgttggaccgaagtttgcaaagagaatcgtgggaaaatttggagaagataccttagatatcatagaagagacaccggacgaactgctgaaagtgccgggaataggaaaagtcagagtggatcggataaaaacgagctggcaggaacaaaaagaaatcaagaatattatgctgtttctgcaaggtcatgaggttagcacttctcatgcaacgaaaatttttaaaacgtatggaagtgagagcatcgccattgtaaaagaaaatccgtatcggctggcagatgacatctggggcattggatttaagacagcggattcgattgcacaaaagatgggaattgagaaaggaaaatttatccgactgcgcagtggtattttttatactttgaatagacttgcagagttggggcactgttatgccacaagagaacagttgattgaaaaagccagtgtccttctggaagtagaacagccggaactggagattacattagatgaaatgctccgtacgaatgatatcattcgagatgtgtttgaagaaaaggaagcaatatatcttccaccttattatttttcggaaagtgtatgtgcaaagagactggttcatttaatgtcaggcagacaaaaaaagtgtgagaatccggaaaaaattttggagaaagtggcacaatcatcccaaattatttatgatgagatccagtggcaggcggtgaaaacagccatttcatctaaagttatggtgttgaccggtggaccgggaaccggtaagacaacgacaacattaggaattatttccgcatacaaacaggcagggtgtgagattattttggctgcgcccacaggaagagctgcaaagcgaatgtccgaagcaacgggcatggaggcaaagaccattcaccgcttgctggaatataaaccaccggaaggctaccagaaaaatgaagatcatccgttggaaggggacgttttgattttagatgagtgttctatgattgatatcatgctcatgtacaatcttttaaaagcgatgccggagcagatgtctttgattttggttggagatattgaccagcttccaagtgtaggtgcaggtaatgtcttaagggatattattgattcgggacaagttccggtggtacgtcttaaccggattttccgtcaggcacagggaagtcggattattatgaatgcacatcgaatcaacaaaggggaagggattgatatgcgtggcggaaaagatgcagattttttctttgcgccaaaagaaagtaatcaggatgtcgtaaatacgattgtccaatattgtaagacaaacctgccgcgatattatcatgtagatcctttgcaggacattcaggtattgactccgatgcagagaggagaatgtggagcgattaatctgaatcaggtactgcaagaagcaatgaatccatcaaaaatctttttgcgaaggggtggaacgcagtatcggctgaatgataaagttatgcaaattcgaaatgactatgagaaagaagtatttaatggagatatcggtacaattacaaaagtagacatggaagagcgggagttgaccgttttatttgaaacaagggaagttgtctacgatgtgacagaactggatgaactgatgcttgcttacgcagttacaattcataaatcacagggaagtgaatatccgatagtcgtcatgccatttacgatgagccattttgtgatgttacagagaaatcttctctatacaggagtgaccagagcgaaaaaaattttggtactggttggtgaaaagaaagcaatttattatgcgataagaaatgaaacgacaaccagaagaaatacctgtctggcaaggcgtttacagtcggatagtgaagaatcaaaggaagccttcagccatctataataagtgaaacaccgtccacatggttagaaaggaaatgtttcaaatgatatatattacaggagattgtcatcgtgaataccggagatttaatactcaaaattttccggaacaaaaaggaatgaccaaagaggattatgtgattgtctgtggggattttggcggagtatggagttttgaaaaagaagataaagaagaaaaacatctgctcgactggctggaagaaaaaccatttacgacgctgttcgtggatgggaaccacgaaaattttgaccggctttatggatatccgattgaaaactggcatggtggaaaagtgcataaaatcagaccctcggtattgcatttaatgcgtggacaggtctttgaaatttgtaatagaagcatttttacctttggtggagcaagcagtcatgatatcagcggtgggattttagagatggatacatcgaattttcacagagagataaagcgtttaaatcgagtgggaataccgtaccgtattaatcattggagttggtgggcacaggaactgccatccaaagaagagatggaagagggacgaaagaatcttgaagagcataataatacggtagattttattgtgacgcactgctgtgcttcgagtactcagcagcttttggggagagagggatttgaagatgatattgagacaaggtatttggaggagatactacagagcacaaactttaagaaatggtttttcgggcattatcatgacaatcagaacgtgacagaaaaagaaatattgttgtatgagcaggtgataaggattgcatgatatgaatcaagcagatattcgcaatttgtctctctgattgattcggttaaaatcataaaaaagacgtcattccatagaagatgattcctctatggaatggcgtttttaatttggtgccttgtctggcgtctgacaccggtcaaagcaggttaggatgttgaatgcttctgtcagagagagttgaaagctccctctgacagatcgcaaagtgactgcgttcatgagcaagtagtgaagtggattgcgaatgtccgctttactgattttgggtggtgtttgacgctgattcttttgattcgttttcttttttctgcttttgtttgaagtttttaacaaattcaggatattctttttggtgcatttgatggttctttatgaaaagattaaagtgttcaggttcacttatgatttcctgtgatggatataagctgtttttgcgtatttgaagaagaacattcattctttcattttcatctggaataaaataagaattactgcttataaaagattcaaggaatactgaacaattagtaaatacagctttatcaggtgttaaaagtctttttagtgtttcgtctttacgcaggtcttccagagtgtcttggtctatgacgattggagtagaatttagtgataaaattccacgtagcatattggttgtattaagattatcaagattttgtcggactcggaataatgccattttttgaaagagtggttcatgagttttgttagtggaaaaggtcagcataccagcaggaatataatatcgaatatcagaatttaaatttaaatatcgaaacataagagccatagccctgcgaccagtatcgtctgaaatgaaactatatgctatagatggattttcaagaagtttcaaatcaccagtgagtttaaacagaggcatagggtctccataaaaagttgtatttgtttttatttcttcaaaagttacgatggtgcgtccttcggttatgttaacattcattttggcttcttgaattttgccatctttaataggttttaaatgttcttgatggtgtttgggattaaaataataacaatagtagtcataagcatgatattgattggtaagctgatgaatcccagagtctttaagtttcccttttgtaatacgggaaaagttaaagtcagatgaagaaggagtctctgttgtttccggaagctcacagatactccataaaggaatatcaaaaatctgcgcaagtgcgacaagctctggaagttttacttctctgtcggattcaccatcgagcatagcgcgtattttactgggtgaggttttgatattaaaccgttgaaacatcatatctgcgataccggaataatttaaagtctgttccccgagagcccgttcaaaatctctcttccatttaaataatcgtttctttacaagggaattataatcttgatttccgtttgaattatctgaagatttagagttcataaaaattcctcccaataataaaaatttaaagaagtataactattttcatcatatcattggtacgacaggagttcaatgcgaaaaaatgccaaaaatgaatcatattatatcaaaaataaaaaatataaaaatcaaatctgttataaataaagttaataagactaatgataaaaaataataaatgtgataatattacagtacatcagatatctgacctttctaaaatctttttaataatcagagattttgaattttaaaagaacagagtttcaattttaagatagtagagtttcaatttatggaaaattagagaaagatgaaagtataaaattatgtttaaataacaagtgtaaaggacaagggataagtttttagatggtaaaaaataagggagcgtggtattatgtataagtgactttgcaaaaatggatttataaaaatcagagatacaaaagagaaacagaagaaaaaatctgatagagaagaaaaaattaagaaagaaaatatatcagaggggaaacggaaaatatgagcgaattttcaactgtattatcgcggtttgtgaaagagaaagatgtcaacgtataccgtctggcaaaatattgtggatatgacagagctaatctttataaagtaatgcgtggagagcggaaaccgccgagtctggaagttttaaatctgttgtgtgaatatatgcatctttcaccggcggaggaagaaattttagaagaaaattatgagattacaatggtaggacacgataactattatcgaagaaaaaatgtaatgaaatttttttctgacttttcaatgaccagtaatttggaaaatgtactgccaacagtagaaattaaagaggactttgaaattccaaattcaagttatatgctgcttcgcggcaattatgaaattaattctgcgctttttcatattattgcagatgaaacaaaaaaccaaaaaggacatattcagatactggcacagccggaacatgcgttaggaaatctgttggcaatgcgtggaaatacttcaaacgaaataataattgaccatattatctgcctggataacaaaccggagattgcatattcaaaatcaaattatacgttagattgtctgaagcatattcttccattatataattacaattacgattataacacctggtattattatgcagaccttggttcattgggaagaaatttctctgtatttccgtatatgattttaacttcaaaatatgtatgtatgctgtcggatgatttgcaggacggatatttaagtaatgacccggaactgattaaaatgatgaaagagcgttttgaaaactaccggagacgggctcatcggttagtggaaaatgtgcagggtgaaattgaacagcagtatatgattatgggaatgttaatggcaaatccttatccgaaatatgcatttcatatgtctccatgtatgatggcagtattagacagagaattgattgaaaaatatctggtgcctcagcttccacaaagagaagaattagttgaggtattatgtgagtatatttcaaatcttcaaaaacaggatatgacttatgtctgctcaatggaaggaattttacagttcattgaaacaggaatcatcagtgaatttccgaaagaaatgtatcagcttccggataaagaagacagaatggagttagtgaagcgactttttgatgaagaaaaagccggaaaagtacatattttgaaaaaaaacattggagatttaaaggcagaattatatttatgcattacaccggaaagcggattgctgcgatttgcagttccatctaagaatgttttaaaagatatctccttagaagaatcaggtttggtttcggtgttctatgacttctgtgaaaatttaagcccggaattattttattcggaagaagaagcaaagagaattattttcggataaatgtagttttaaaatcaagcacagaagaattatgagagtacatataatcagaacagagttttttggaagaaaaagccggaaagctctgttttttgttgtacaaaagtagaaaaacaggtaaaataaaagaaaaattgtcgaaaacagaggaaaatgatttgaaagtttgtatgaaatgcaagagagcatttgaagacgaaaagaaagtttgtgatttttgtggggaaccactaattgaaatcagagaaacggatggagtaaaaaaagaaagaataaagaaaaatccaattgtatttgcagtggctggaattgcgatcgcattggtggcgggacttggaattggttcgctgacaatgaaacagcttgtaactggaaaaaatgaaaaaagtgcggtgcaaagccttgaaacagatgaggaaaacgtgctcggagaagtaaaaaaagaaaaaggtgtttcaattgaagatgaggaagaggaaacggacgaagatgaagtgccggaaattaaggtaggggaaacctggactgtggatggtctgtggaagattacgattaattcggtgacggagacggaggagagagatagctataatgatagagaaaatccagaagctgtttatattgtagattatacgtatgaaaatctgggatataaagatgagtactcaaaaggattaggctttgatttagacggagtttacagtcaaatcgtagattccgataaagagatgggctatcactattatatatcaaatcttaattcagttgagcctgtaccgataggggcaagaaagactgttcagacagcaataggggtgaatcataaaggaacattttctattttatatgaaagagatatagaagatggagaagatgaagatgagtataatactaaagtttacaaagcaaagtttatctgtgaagtgaaagagtaaggagagcaggagtatatttaagaggaaagagagaaagaaatatggcattaatggaaaagtacgatgcatttatcagctacagtcatgcagaggataatgcagagattgcggaggcacttcataaaaaactggagcattatcggattccttctcaaattcagaaaataacaggaaaaaagaaaatagaacgagtctttcgggataaagaagaattaccactttctgcaaatctcacagaaaatatttataccgcattagataattcagaatatctgattgtgctttgttccccggaatcacgggcatctcaatgggtgcaaagagagatagaatattttgcaggagttcatggaaaagagcgtatctttgcaatattaataaaaggagaaccggaagaggtatttcctccaattctctgtgaaaagacagaaataaaaacagatatcaatggtcaaaattacataattacagaaccagttgaaccgcttgcagcagatgtcagaggatattcaaaaaaagagaggataaagaagttggatgcagagtttttgcgtttgatagcaggaatcctgcagtgtccttatgatgagttaaaacagcggcatcaggaataccgaatgaagattgcaattgcagcaatgagtgcagtcatgtttcttggaatcgcatttggcatgtattcagcatatcaaaggaatcaggttaatacagcatatcagcagtcattaataaatcaaatgaagagtctgtcggaagaatcagaacgatatcttgatggaggagacaggataagtgcactaaagacagcacttgaagttcagatagaaggacagagcagtatttatccgatagtaccggagcaaatctatgctttaaataaggcactgtatacctatcagcgttcaagcaattatatttataagccagaaaaaatgaaaaccatggatggggcagtaacagaggtaaatggcttcagttcagatggaagtttgttttttgcacttgattcctttggacaagcttatttttatgatacagacacagaaaaagtggtatggaaaattaatgcagaaaaagttttcgaaacaacaggagaaaattttatctggggtaaatttaacggaaaccattcgattgtgatggcaacagaacattactttgtggcattggatgtagaaaaacaatcctgtggagcgattgcgaaaacaaaaaagaaaaatcaaaaagatcaggcgatggatttgtataaaaacaaattagcggtgtgttataaaatcaagaaagaaaatgccaaatatgacagtatcagtctgtttatttatgatatggaaaagggggaactttcagagacgtatgattacctttcagaaaaagaaacaaaatatatagctgagattgatcagattagtaaaatagttttttcagaaaatggaaattatttggcaatatcaaaatcgtggcgtagcctaagtggtgaggacgaacaaagtaaaatgatttctatttatgatatgaaaaatggagaaattgttcagaggtttggaacgaaaagtgttttagatctttgttttatagatgaagatgcagttgcttcggtagaacatagctcatctttatcgccatactataatggatgggaaatgcaggaaagtatttacagtctaaaagatggaaagagcttgtggcaaagccaaaagactagaataacagatacgatagcagtagataacccagccgctttttgtaaatatattagtaaggttaatacagatacgaatggagaaaaggcagaagtagttggatttagctgtgaaggaaatttgacattggtaagaaaaggcgattgggatattctatttcagaaagattttgaatatgatattgtggaaattcaaaagatagatgacaataatattttggttggacttaataatggaaccgtttatcgtgttatgacttgtagtttgtggagtaagatgttgattgtagatgctgatattagtgaagaatattacaacgcaaagatagataaaattgttcagctaaagtcacatgacttagtattctcaaaaaagatatttgatgaatctatgaaaaaagagggaacaaaacgaccagaacttggaaatgatgtaaccaataatgaaggagaaaaagtagttggaacaaagtacagggcagaagttgaaggtgattcaattattataacggacagaaaaacgaaagaaaccgttttgacaattcccatgtatcaggcagaagagatggtttacggattttttaataatgatgaacaatttttggtatataatgaacagtatgaggaaattgtagtctgggatatggaaacaggaagtattttaaaacagcaagaactggatttggaatccccggttaaaacacaaatcattatagatgaagatttgcatctctttgcattaaatcttgaatatggaaacatatcgtttacggctgaagaaacaccacataatacattagatcttttttattacgacgatgagtttaatatttatcggtatgcaagtattccttatggggatattgatttcaaaaataagaaactatatgtaagagatgggcaggattattattcgacatggatttacagttatgatgaactggtggaaagagcagaaaaaattttaaaagaaaaatagaattaatagtggcgaaaagtgatagtgacggagttttctggtttggcggaaagctccgttttttgttgtagaatttcagcaaggagtttcaaaatttgaaaaagatgggagagttgaaattgggagaagatggtttaataaagatagaaagtgaagagaaaccttattaaaatctaaagtaggaggaagaaagtatgtggattattataatttattatgttgggataccattaagtgcaattgcgggtatggcagttattttgtattatctttttggagaacatggagagtggataggaatggcatctaatattatggctttgtttatgttagttggggctgtaattggatttctttcatcattgcatgaattagtttatggtagattgattaaaggagataaatcagttggaattatggaaaacttgtttagtatgttggtatatggtggtttagcttttatgataagctgtttttttattagaaattatctcatgtaagcaagtgaaataacttatttgagagagattgcgtctcattttaaataaaatttgacgacaaaaatcgacacgtattgtgagaaaatatttaaaaaggtaaaataaaaagcaagaataacagcttaaagggggaatatttcttatgagaaaagaaaaagaactaagtgcaatgaaaaaattcatcaagaaaatggcaattgcagttcttacaggagcaattgcattttcggttgtacccgcaacagttcaggcagcaggatggaaacaaaacaagaatggatactggtggcaggaaaatgattacagttatccgaaaaatcagtggaaaaccatttatggaaaacagtatcattttaattcaaagggatatatggataccgactggacgaaggtagatggaaaatggtattactttggtggaaaaaatgatggagcgaagaagacttactggcaaaaggtaagaggaaaatattactggcttggaagcaatggtgtgatgagaacaggctggcaaaatgtatatggaaaatattattggcttggcagttctaatgacggagcaatgaagacaggctggcaaaaagtagggggaaaatactatttacttgggaaaaatggtgatatgaaaagtggctggcagactgtatatggaaagaaatattatcttggcggtgcaaatgatggttcgatgaaaacaggttggcagaagattggtggttcggattactactttggaagaactggggaatccaatgagggtgttttaagaacaagtacctgggttggaaattattatgtagattcatcaggaagatgggataaatataaaaaaatagatacaagtaattacatgttgaatggaaaatataaaaatttagtatcggatttgggaatgcaagtaatcgataaaaagtcaaatcgttataagaaggataaagtagagttatattggatgcctggagattgttttggagtgacaaatgaagggacaagttttgtaaatgtgtatggaattgtacctggagattccttgaatagagctagaagtatattagtaaataaaggttggacagaagttaatggatatagtagtaatagctataattatgtatttctaaaaaaaatagacgaaagacttcatatggtagaatttgatacgaattcacgtggaattttgcagaattggtatttgatgaattggccacaaggtgagtgggttctagagtattatagcatgaagtctgaaaatgcggtagtaatggaatcaccacagcaggaatctgatacaacagaaactgaaattccagataccgaggcaaatagcgaagaacctgcacttccagaaacaacagagcaggaaacttccgatgcgactcagaacgagaataatacaacagaaatagaagaagaacaggcaactcaggaagaacaagtttctgaagaagagtcaaccgaagagactcagcaagtagaagaaaataaagaagaaaaccagtcatcagagatgataaatgaataataaaatactgtccgagttaaagggggaaaagctaatgtattgtaataattgtggcacacaaatggcagatggagcaaaattctgccctaagtgtggaataaagatggatattcaaaatccggcaaatcaaaatccagtaaatcaaagcatgggaagtccaaatatgggaaaccagaacatgggaaatcaaattccgaataataattatcaacccaatcctgcacctgtttattatgcggctgattcaggtgaacttccaatgcgatggtataaatttgtgatatgggttcaattatttcttaatgcattgttaagcatagtttctggaataatgactatgacaggagcacattatcaaggacaggcaacagtggtttatatggtttatgggagcttgaaaggattagatattgtaatagggattatgatgcttgtattagcaggaggagcaatctgggtaagacagatgctgagtaaattccagaagatgggaccaactgcttatgtaattcttttagcttcaaatggtgtagtaaatttgatatatgcgattatggtatctgctattacaagagtgaatgcgtttagcaccactgtaatttctcaaattgtagcaagtattgcgctgtgtatttgcaattacatttatttcaataagagaaaatctatgtttgtaaattaatcaaaggagcatgtagagagtaaaatctttgcatgctgtttttgcgttcaaaatttcaaaaaataatttcaaaattaaaaaaatatacagtcaatgaaatcccaggaaaatgttttaataaagacagaaacaaagtgcaatgcgtcaaaagataataaagattgacgacaaaaatggacgcatattgtgaaaatgcactaaaaaagttagaattacattgatttaacagaaaaaaacacgaaaaggagaaaagtatgaaaaaacaagggattttgaaaatttttgaaggaatgatgttgattgcaactacaacagcgtgtggttcaagttcagcaggagtaaaaaacgttgatttaaaagacccagatggagattatcatgttcaggttgattttaaaacaaatgaagtaactctttcctgtgatgtggaaaatgatgatacgggaacaggcgaaggctggtctgaaattttaaaagcctgcaatagagagcaggattcagcaatcaattttgaaacaatgtcttttaatacaacttataaaatgtcagacgattttaagaaagtattcaaagatttttgggaaaatgattttcaaaatgaatactcaggggttgaaattaatgaggatggaacgacagcagatatagtggacctttgcagatttttagcattgggagaacagtgggaagaaaatccgaatttacttgttacagaacgtccggttgttgaagatggagcagagggagcagtagaagtatttgtaacgtatgatggaaaggaagaaaaatttcagaaagcagatacagataaagatggatacatttcagtacaggaatatattaaaatgatggtttcaaattatgaagaaaccataaaagaatttgagtcaatataaaaatagcagaaggggagttggtttaaatgaaaaaatcaaataaagcgttaagtatcgtaatttcaattatttatgcagctgttgctgttgaatggattatttcgattgtatcacaatatctgaagataaaaggtggtttttcacctgtagcagaaattttatattttgttccggcagtattgatgttaattattgcaggtctggaaatttatcgtttggtgaaaggaaaatataaagttcttgattcggtattatttttaattttgccatttgtaatgtgtatctctgcatttgtgcttgcaccaggtattgtggatagcaatggagcatatcatgtcagcatcataagctctgtgagtctgatgtattttgtaaaagatttagttgcaattgtagcagggcttgtggctcttgtactggcagtgattaagaagaaaacagaaaaataaaatgactgtaaatacagtaaatgcaatatgaaaaggaggagcacaatagatgaagaaagcaaaaaaacctaaaacgatgaaaatgcttatcaaaaaaatagcagttgtagcttgtgctgcaacgcttgcattttctatgatacctgcaacagttcaggcagcagggtggaagcagaacaaaaacggctactggtggcaggaaaatgattatagttatccaagaaatcagtggaaaactatttatggaaaacagtaccactttaattccggtggatatatggatactggctggacaaaagtggatggcagatggtattatctgggggcaagaaacgacggggcaaagaaaacttactggcaaaaagtgtatggaaaatactattggcttggaagtaatggtgtgatgagaactggatggcaacaagtatatggaaaatattactggcttggcggttcgaatgatggagcaatgaagactggctggcagaaagtaggaaaatattactattggctcggtcattacaatgatggagcaatgaaaactggttggcaaactgtctatggaaagaaatactatctgggcggagcaaatgatggagcgatgaaaaccggatggcagcagattggtggatattggtactattttggtggagtaaatgatggttcactcaagacaaatacctggattggaatttatcatgtggatgcgaatggtagatgggataagacgaaaagggtagatataggggagtatttaacagataagaaagatgtgcaattagtaaatgttctgggtttaattcagacaaagtcagaatatggaagaaaagaatatgcacgagatcaaataacttattattatcatgatagtggttctggtacttattctcacacatttggaattacgaatgaaggaaataaatatataaatatttatgggattgttccaggaaactctctgtatgatgcaagaagcatattgaaagccaaacaatggaaagaggcacaagagaattatagtggtgataaatatgattatttgttccttaagactataggaaaacggtcatatatgattgaaattcatactgattcttctgaaataataactagttggtatgttatgaattggccacagggtgattttacaagccctgataatttgaaagagatttcattggatgcttccttagataattcttcaccagtagtatttcagaattcagaagaaaataaagctagtgttcaggatgtagaagaaagtgaaaatcagaatgaatccccagttgtaattccagaagaaacacagggagatgaacagaatggcgagcagaacttagagcaggatgaaaataaagaagtagaacaagatacaaaagtagaacaggatgcagaaattcaggcagatgcagaaatttcagaacaaccttcagaagaatttcaatcagcagaaactcagaaaaccgaagaacaagtagatgaataaacttaagaacctgtggagagaaatctctgcaggttttttgacttttattaaagtatgatagtgtggtataataaaaataaatcaaaagagaataacatgatactaaaaggagttagaaatgataaaaaagcaagaacttacgttggaagaaaaagaagaaaaagttcgagattttcgtccaatagatgatgctttttttgaaacgctggcagatgatatagcattttgccaagagatactacgagttatattaagtgataaaaaattagttgtagaagatgtaatcgtacagaacagtaaaagaaatctgtatgggcgttcggtaagactggatgcattatgtacacttggaaatggaacaaaatgtaatatcgaagtacagcgatcgaataatgataatcacttaaagagggtaagatataatgcggcaagtatagcggttgtggattcccaaagaggggataaattcagagaactggaagacttatatgtggtgtacatttccgaatttgatgtatttcatggcggttatacaaaatatcatgtggacagtgtagttcgagagacaggaaaaaaagtaaaggatggtctggagagagtctttgtaaatacggagataaaagatggaaccgaactttcagaactaatgacttgtttcttggaaaaagaagtagataatccgaactttccggagttttcgaagcgaatgaaatttttaaaacatgaaaaaggaggtctggacgcagtgtgtgatgtaatggaaagatatgaagagattgcagcagaaaaagcagaagaaaaagcaaatattaaggcagtgaaaaacatgataaaagtatttcaggcaacaaagcagcagattttacagatatattcggaaaaagaatatgagcaggctgtgaaagaactcgaagaggaagaaactaaataaaaaaataagagacaaataaaataagtgataaagaaactaaaaggagttagaaatgggagaaaagcaagaacttacgttagaggaaaaaaaagaaaaagttcgagattttcgtccgatagatgatgctttttttgaaacgctggcagatgatagagcattttgccaagagatactacgagttatattaagtgataaaaaattagtcgtagaagatgtaattgtacagaacagtaaaagaaatctgtatggacgttcagtaagactggatgcattatgtacacttgggaatggaacgaaatgtaatatcgaagtgcaacgatcgaataatgataatcacttaaagagggtaagatataatgcggcaagtatagcggttgtggattcccaaagaggggataagttcagagaactggaagacttatatgtggtgtacatttccgaatttgatgtatttcatggcggttatacaaaatatcatgtggacagtgtagttcgagagacaggaaaaaaagtaaaggatggtctggagagagtctttgtaaatacggagataaaagatggaaccgaactttcagaactgatgacttgtttcttggaaaaagaagtggataatccgaactttccggagttttcgaagcgaatgaaatttttaaaacatgaaaaaggaggtctggacgcagtgtgtgatgtaatggaaagatatgaagagattgcagcagaaaaagcagcaaaagaggcagcagaaaaagcaaatattaaagcagtgaaaaatatgattcaatttaatatttcaaaaaacatgattttgacaaaatattcagaaacagagtatgagcaggctgtgaaagaactcgaagaggaagaagctgaataaaaaataagagacaaagaaatgataaagaaactaaaagaagtttaaaggaaatctataagtaagaacgatctaaataaaaattataacgtggtgtaaaacagtatgtggagaaaaaagtctttgcatgctgtttttatatttaaaatttcaaaaaatcatttcaaaatttgaaaaatatgaagatactgaaacttaaagaaaatgttttaataaagacagaaacaaaaagaaatgcgacaaagattgactacaaaatatgacacgcattgtgaaaatgcacaaaaaagctaaaattatagcaatatatcagaaaaaatgcgaaaaaggagaagcgttatgaaaagacaaatcaattttaggggggaggtaagcaaaataactccataaaagtcatagtgtagtcagtttgatttcaaaaagaaaaggagttgttttatttaaatgcgaaaaacaggaaaagcatcaaataatataattaagattgtgtacatacttttggcaattatatgggttgcagtcagtttgctattctttttggtaggcagtaatttgggttcagttggcaaagtactttattttcttccaacggttgtaatgctgattgtaattgtagtaggaattatacatttatcaaaagataattacaaaaccagagatgctgtagtacttgcggtattgccgtggatttttatagttgttgaatttgccgtgtcagtgagtcaggatgccagtagagcaagcattgaagtgttcatgggttctttctttcagggcgttataactggaatcgtaggaattttgatttttattgtgaaatacacaaaacaggatatccaggagaatgaaaaattaagcaagatattagataacatgatgaaggcagtatatgcaattgcagcagttatctgggttattttaagcatctttttattcacgagacttagagagcctgttataggtgcaaagataattatctactttattccattattagtagttttggcaattatcggaagtcaaatttatttccttatgaaagaaaagcatacaatgataaatgctttaattgttacagtattaggatgggttttggcaattattggattcatgaatttatcaagcagagactttgattcattaggaattgcaatgttcgtaggatatatgtttccggcactggcagtgggaatacttggaatagtagttgtagtgctgactgcaatgagaagaaaatacagtaaataagaagtgcggatgaacctgtggagaggagtcttcgcaggtttttttggcaaaataaaaagtgaagctcttcctgtgaagatttcttgtttgaatggcaaaatggaaaatatgaatataccttacgaggtggtcgtttagtagcgatgtttacagtaaaatttacgcctaccgcagcaggtatgagaattcaggttacacagcaggatggacaaagatactcttgaatagggggatatacaggaaataataacgtaaaaggacaagatattgaatatagagagcggagttttgtagatttacagaacttcgcttttttaaagataatacagaactgattaagagtttcaatttatacagaaaacagtttcaaaaagtggataaataaagaaaaatgaaattaatagaatatggtttaattaaatcagggaaaagaagacaagttgttattttcttattataaaatttttgcgtctgaaaacaaataaatattgccgacgaaaatggacacatattgtaagaatatagtgagaaaaggtaaaattaaaacaataaaatcgaaaaatgaaagaggaggaaaagaagatgtattgtggaaattgtggaacacagaatgatgaccgtgcaatgttttgccagagttgtggagcaaaactaaatggaggaggaagtcagaagcagcagcaatatgttggatttggaccgggtggtcaaagtacaggatatcaaagtatggtatatgaatcaaaaggaatcggaaaaacagcaatggtctctaaaatcgtttcggttgttctgtttgctattatagcgttatttttctttcatgcggctgatgaagcaaagtattcaatacgggcgtggtcttatgctttacagacagggaattcattgtcaagtaactattcaataatgggaacattttttatgataggggcaattggagaattgattgtacttgtattgtattgcatttcctggactaagattgacagcgttggtatcacagccagttgtatggggttaaggcaaaattatcagatatcagacatcacaagtgtcaggacattatttggaatttttgtatttattcatggaaattcaggaacgagaagaataattgtagatgatcctaagagagtacaggggattttagagagtatgatatatagagtttgattaaagagaaaaagattattgcagtaacggagttttgtaaatttgcagagctccgttcttattatcagaagaggagaaaaaaacatggatgaattatatgtagttgttttagaaattagtgctgaaagtgatggttattatgtaaaagaaaaaataaatgaaaaagtaattatggattcaccggtacatagatatgatggatttgagtttagaatattatctgctgacgatgaatttgtacaagcgttaatctatgctgataatccttatacaacaagagtactgggcttaaatgttgataatgcagggaaaaaagttggagtgttgtttgatagtccggtattgattgaaacagatggtgggtttgcaggggtattgtgttcctatgtttttcaggttagcagacattatatagacgtgaataaaatgtatactttattaggagcagatattaaaagtagaaaactgatgatagaaagttatgctggattaagagacaaattgctggagcaaaagagaagaatggaattttctgaaatgatgcattacatggaacggaataaagatttgcagagccatactttgagaatggttgaacatacaaaattgtatcaggaaaattttgtgagtaaatatgaatcaatgaaagctggaagagtaagctgcgaagaaagtatgatgttaatagtagcaaaagcttatgcagaagaaggtaaacacgttgcagtactgaactctggaaatccagttgaaccgaatggtcagatatttaagggatcagatacagaagaagagaaaatttgtcgtgtaagtaatttgtatgaggcgctgatatcagaaaatacgagtgagtattatattttaaataaagagatatttgaaaaaaatcagttcaatagtatgtttttaggcacagatcgggtactatattcgcccgccgtaatggttatgaaagattatgttggatatcgaccatcttggggaatggctacggaagaatatagagagacaccttattttgttgatgtattaacctgttcggcacctttcttcagtggtttgggatatattcttccagatggagatttagaatatttgttaaaaagaagaatcagaaatatttttgaagttgcaatcgaaaatggcgtcgagacgtttattataggggcgtttggatgtggagattttcataaccctgccagtacagttgcaagagcatttaaaggtgttctttcggaaaaaaggtatgagagagcatttgaagatgtaatttttgtaattgaaagcaagggagaaaatcgttcggatatagaggcttttaagacaatataaaggagcaaaatttgacagggcagtttttaaattgcaaaatttttgcgtctaaaaacgaataaaaactgccgacgaaatctgacacatattgtaaaaatatactaaaaaaaggtacaattaaagcaataaaatggaaaaataaaacaaagaaggaggaaaagaggatgtattgtggaaattgcggaacacagaatgatgaccgtgcaatgttttgccagaattgtggagcaaagttagaaggaagagcaggaggtaatcaaaatcagcagtggcagcaaaatattgattatagttatcagaatgaaattcctgggcaggtttcaattcagggaaagaaaaaaggaaaattgaaaattctgataccggctatagcagtagtagctgttgtgttgattttggtatttagtttaactggaagaagagggtataaaaaaacagtagaaaattatgtgcagggggcgctggatggagatatagagaaagtagtcagtgtaataccagagggctatatggagtattacggtgtggacagatcaacagtaattgatatggttgaggaagcacttgatgatagtgggctctatgatttattagatgaagactgggaattcaactatgaaattggagatgcagaagatattaaaggagcggaattacaggaaataaaagatgattgcagtgacagtggagttaaggtatctgctgcaaaatcggtagatttaaaacttactgttacaacagaagatggaccagaatctgaaacggtttccattccacttataaaggtagggcgtaagtggtatatcaatattgaagaatttatgggattattttattaaaacctcatagcaaaagcgaatcatacgaaagtaaaattgagaaaagaggatgagtttatgcaaagaacaaaaattggaatttcagcaggattgttaggtgcaggaatttattttacaggattattcagtggttatttgataccgataattttgacgttctatgtactttggtttgaagagaatggatggttgagaagaacagcagtaaaagccgtttcagtcatgatattcttttctatgattacattatttgtaaatttgtttccggatttcttaggaattatcagtagttttgttggaacttttggtgttgaattttattattcttcagtaaatagtttatttgattccatagttaaattgattgatttaatgagaaatattttgattttaatattgggattcaaagcatttggacagagtacaatttatattccggttattgataatttactgagtaaatatatgcaataaaagagaagggacagcagaagaagcaattgtagtagatattctgggaacatttacaattagattagagttatcggatggtaaaggaaaaaagctttatagtgcaaaatttctctgtgaagtgccatgattccatactattttatctgttttcagagtttcaaagaatgatttcaatttatcattaagcctataatgttgaaactttatcagcatggtttaataaagacagaaaaacaaaggaggacaaatgatatgaagaaatcagaaaaggcaatgggtgtattaattggttttatatatgtggtactggcagggggttggattgcttcagggattcattataaaagttttgcattaatgttgatgcagacttcaaagattggaattgtgtattatgtgcttcctccggttgcaattgtatttcttgcaggaagcagtttatgtgagctggcaaaaaataaaagtattgccttaaacgctattatgggtatcatattatcgcttgcaatctttggagcagggatgtatagttattccagattaggatatggaacgagagattatgttttgtatacagcaagtgcatacttaattatttcggcagttacgattagtgtatcgtttattttaatgatgttgaattcggcaaagaaaaaaatgaaaacgaattagaaaagcagaaaatgaaaaagacgtatgagaaaatatttcaagtgcgtctttttttaaagaaaatcataaaaaatagagtaaatgaatatacagatgaaggaatttgttttaaaatagataataagaaaaaatgaacaggagtgattaacgatggcattttgggatgatttggaaaaaaaagcaaccgacgcaactacgaatgtaatgtctcgggtaaagggcgtgtcggatactacaagattaaattcaatggtagcagaagaagaaaagcgaatcaaagacatctattttaaaattggacagacttatgtagcgttacatggtcaggaaaatgatgctgcatttgtaaacctgcttaatgcgttaaaggcatcacagttaaaagtagaacagtataagcaggaaattatggatatcaaaggcgtacgcagatgtgaaaaatgtggtgcagaagttcagaatggagccgctttttgtatgtcttgcggaactcctcttccaaggattcagccacaaccggtgaatgttggaagaacatgtaagaagtgtggggcaaatttagcaccgggagctcgtttctgtacaaattgtggaacaccttatgcggaagaagcatcaggaagtccaagcggaaattctacaggaaattctacaggaagcgctatgggtagtgctatggggaattcatttggaagttcaaagcctgtagaacagccaaattatgaaccacagcaaagggaagaatcggattcttatcaagagccaatacagaaagaagaacagcttcaaaaacaatgggaaaatcctgcaaaaaaagtatgccaggcatgtggagcggaacttggtgaaaataccagattttgtattgtgtgtggggcaccagctggacaagcaccaaataacgcagaacaaccacaaaatataaccgtaacagtgtctccggttacacttagtaaaccagagacacaggcagtacaaagtgaaccggcaagaacgaagttctgtacaggatgtggtgcaccacttgaagatgattcccttttctgtaccgaatgtggaaaaaaggtagactaaaaaagagataaagtgataacctgcaggaagaaatttctgtgggttatttttatgtaatgaagctgcaaaaatactgccgataaaatctgacacacattgtagaagaaaatgaaaaaagttaaaattgtaacagaaaagaaaaagaaagggggattttaaaatgcagaagtcgagtaaagtactaaatataataataggagtgctgtatgctcttttgggaatcatatggcttatttcaggaatctcttctttaggaaatgtgcagattctattaggaacgaatatactgacatatgtgtgcttgttccttccggtattggtagtatttgctattattggtattagtttgtatcgtctgaagaaaaacgaaagtacaggattgcttgctttattatgggtaatcgcatctgttataatgttttttgtaggaattgttttatataagcagtatacatcagatggaacatactttgaaacattgttttatacgctggcattttattttgtggcagtagagttgactgttcctggtggaattattattatgatattaacagcaataaagaagaaaatagagcgttaaattaagattatggattacaatgaactgatatcttgttttcaagatacgataaaaatgtcagaagatgagcttcaggatgcaactttagaagcaattgacaatacctgtgtattaaaagaaaatatctatgaagaagtatttgaaaattcaaatgtcaaaatagaagaaagaccagaagatgcggatgtgtttgttgaagttaatacgacttttgcaacagcaaaggaatatttgcaggatggaaaagtagcagttttaaattttgcaaatccgatatgtcccggtggaggagtacaaaacggtgcaatcgctcaagaggaatgtttgtgccggagtagtaatttgtattgttgcttaagagaggaaaaggtctttgaagattattatctatatcatagaaagatggatcattatctgagtacagacagattaatctacagcaaagatataactgttttcaaaaatgacaacagaattccggcattaatgcctgccagaaactggtttcaggtagatgtcataacttgtgcagcgccttatctgattggaaatgtaaatattgaccagaattcattaaaacgggtctttttgaaacgaatacagaacattttagatgctgcaattttaaaccaggtagatacgattattctgggagcttttggatgtggagcatttaagaatcctccggaccttgtagcacaggctttttatgaagtgatttatgactgggattataaaaaatattttaaacgaatcgtgtttgcaattaaatctaccaatatgaagtgtagaaatattgaaatattttcaaaatattttataattaaatcagtttcagaagaatgtctgataggggataaacagtatttcaaacaatggcagaaaacaaatccgtattttggtaaaaagttttcagttctgggagattcaattagtacattagaaggttgtcatccacagggatataaagtgtttttcaaagatgagatatgtaaaagaacgggtgtcgtaaaagaaaccgatacctggtggggaaaagtaatttgtttttttggtggagagctattagtgaataactcctggtcgggaagcagagtgacaatggttcctgaaaattctgaattatttccttctgcatgtagtgatgaaagaacaggttttttacattgggatgaagaagtgccggatgtaattcttgtttatttgggaacgaatgactggggatttggtgcacttttatccagaagagataaaagaaaaaagaccagacctcaaatagcaaattattcaagatatcaggaatttgattatgcttatgataatatgcttaagaaattaagacgaaattatcaaagtgcagaaatctggtgttgtacattaggtgtaacggaaatgtcttcaaatccttattttgaatttccttatgaatattgtggaatgaatatagaagcctacaatggagtaatcaggaaaaaggcaaagaagcataagtgtaatataatagatttgtatgcagaaaatcaaccttatgataccatagatggcacacatccaaataaggatggtatgaatactttggcgaaaatgatagcatcaagtatgttatgaaaagataaaaaacaataaaaaataatagaagaaaagactggtgaaacctaaaaggattatgatagaaagcgcaatgtatgaattaaaacaagacttaaaactatatggaaaaccattattgttaacagcaatggtacttgtggcaatgcagttgatttttcatgagttatgtcctatgaagatacttttagggattccctgtccaggatgcgggttgactcatgcctgtctggatattttgacattccattggaaaaaggcatggaattggaatccggcaggatttttgtgggtaccgtctattcttcttttattgtggatgcgatatataaaacagcatagaataaaatatgtatttgtttttttctggtttacagtcggtatgacactgctgaattatgtgattaattttgggaacattattgcagagtataaggctttgtgataaaatttctataaaaaatattatatttttgtaaaaaacaaatgaggaggggatctcaatgagatgcagtaactgtggtggagagaatgagagcggcgtaaatttttgccagtactgtggagcaaaattagagcaggaatcaaatttctcccaaaacgattttgacaagggtcaggcaggacaaacaggatatgatccaaactatagcaatcaagcagaatacagcaatcaaacagattatagtaataatggaggatattcaggacaggcaggatattatcaattaacagaatctcagcttccggaagaatacagaccacttaccatgtggggatattttggatatcagttattattctgtgttccatgtgtaggatttatatttttgttaattattgcatttggcggaacaagaaatgttaaccttaaaaactttgcacgttcttatttctgtgtgtggattataatggtagtattaattcttctgttctcagtaatcggaggcggttttgcgacgttattcagtcttggatattgatattattaaaagtagaggggatgtcccctctatttttcttcctcttgacagtaatcctcttacctgctatgatgtcaacaaagcaattcttaaattcaaattcaaatatatctttttattcaaaaatttttccaagattgtaaataattcaaattttagaagctttttaatgatttcaagcctaagacttcctcgttatatgtaaaattccgttaaaaacagaataaaacctcgaaaaaaatgcaaaaagtgtgaaagttttgtgaccacaaagtttgacacatattggttatttgttgaaaatttattaaaatagatgacaaataatgatattattatacatttttcgcaggagggaaaggctatgaacaaaagatttgtaaaaagactgctggtgttctttaccgtgttatgtatgacaatggcaatgacagtgccggcactcgcagcaggcagtggaactaatgccacaacagatgacccggcaaacggtattcttcaggtaatgcttgcctatgttgatgatgggggtaacagaacttactttagtgccggaacttgttttatggttaatgaagagtatgttgtaaccaataaacatgtatttgatttggatacaacagattctgacggagtgacacttcgtgacacaatcgtagaaacaatgggactgaaaagtctgaaaacaaatgatactcacttgaagttatatgtatttacaaacagagatacaaacgtagaggcaactgtagatgcaaatgcacagagtgaagaactcgactttgcagcattaaaactttcaagaaaaatttccggaagacagccattagtacttggtgacagtgattctattaaaccacaggatactgtatttgctttaggttatccggcagattcaattcagaataaacagtctaatacaaaagaagatgtatctatcacaaatggtattatctctaaggtaactgtaacagacaacgttgatattattgagcacacagcttctcttaataatggtaattcaggtggaccgcttcttaatgcagataatgaagtaattggaattaacgaatttatcatagggcagaaaggatattccatccagatcaatcagattaaagatttgcttgatacttttgaaattgcatacacagacggagcaacaggtgcttccacttccacttctaactcaaatgatgcagaagagacagaagaaccagatgcttcaacagaagaagaaaccacaggtgaggcagaagaagagaaagcaacagaaccggatgcagaccttgtaacagcacttcagagtgaaattacaaaagctaaaaaaattgaccagaaaaattatacagaagagagcgcaaaagttcttgatgatacaattggttctgctgaaacagttgcagcaaataaaaaagcaacaaatgaccaggttacaactgcaacaaatgatttaaagacagcaattgataatctggaagaaaaatccggaccaaacatgattatgattgcaggtatcgcagcagcagttgtagtagttattattgtaatcgtagttattattgtagtatcaaatggcaagaagaaaaaagcagcaccggctcataacaatatgcagcgtccaaatacaccaccgactcgcccacagccagctccacagcagcagccacagtacagtccggttgaccagggtgattccggaacgacattattaaattctggttcaggcgaaaccacattattaaatggtggcggcggaagtgcttatcttatcagaagaaaaaatggtgagaaaattatgattacttctcagaactttgcaatcggaaaagaaagaagaagagtaaactattgtgtttctgataatacatccgtcagcagataccatgcaattattacgaaaaaaggttctgattattatgtggctgaccagaaatcaagtaactttacttatgtaaatggtgtacagttaagcccatatcaggaaacactgcttacagacagatccactctgaaattatcagatgaagaatttgaatttcatttatcatagttgctaaatgattaagaacagtgtaggtgaaaaagatgggatttttaagtgttttacatagtgatgtaggaataaaaaagaatacgaatcaagattctgtcttaattaaagtggcttctacagactacggcgaggtaatgcttgccgtggtctgtgatggaatgggcggccttgccaaaggtgaggtcgccagtgccgctttaattaaggctttttcagattggtttgaacaagaatttccagaaattttatacaacaaaagaaccgaaaatggaattgacagactggaactggaaaatgaaatgaatcagcttgtacttgaagttggcgaaagaatctccagatatggagagatgtctcacgtagcaatgggaacaacggtggcagtgcttctgatggcagaggggaaatatcatatcttaaatgtaggagattccagagtctataaactgaatgagactggattaaatcagcttacaaaagatcagacctttgttcagaaagaaatggaccagggaagaatgactcctgaagaagcaaaagtacatccacagagaaatgtactgctgcagtgtgttggagcaagtgaaattattattcctgagttttcacatggtgaatacaaaacaggagaagtctatatggtttgttccgatggatttcgtcacgtcattgcaaaagaagaatttgaaaaacttatggagccgaaaaaaatggatacagaaaaggcactcaaagatgttgccgtttactgtaccgaattaaataaatcgcgacaggagaaagataatatttcagtcattctcctgaaagtatgctaggggataaatgaatgctggaaataggatcgattattgatggtaaatataaaatattaaataaaatcggccagggtggaatgagcgtcgtttatctggccatgaatgaaagagcaaataaacagtgggcaattaaagaagtccgaaaagacggtgtgaaagattatgatgtcgtacgtcagggactgattgcggagacagacatcttaaaacgtctaaatcatccacatctgccaagtattatcgatgtcattgacagagatgataccttcctgattgttatggactacattgaaggaaagtctctggaccactggttgaaaaaggatggcgcacagccacaggaaaaggtagtggaatgggcaaaacagatttgcgatgtattaggttatcttcattccagaaaaccaccgattatttatcgtgatttgaagccggcgaatgtaatgctgaaaccggacggtcagattatgattatcgactttggaactgccagagagtttaaagagacaagtatagaagatacttcttgtcttggaacacagggatatgcagctccggaacagtatggcggtcatggacagaccgatgccagaacagatatttatacactgggagcaaccatgtatcatctgttgacaggacataatccaagtcttccaccgtatgaaatgtacccgatacgaagatggaatccagctttgtcatcaggtcttgaaaaaatcgtattgaaatgtactcagagaaacccaaatgaccgatatcaaaactgtgcagagcttatgtatgcactggaacattacggggaattagatagtgcatacagaagaaaacaatcaattaaatggaaatcctttgttgcgtcctgcgcattaactgttgtgtcattggcaggaagtatcggatttaaagtagcagaatcaaaaacaattaagaatagttatgatggatacatcagcgaagcaacaaaagtaaccacgcaggaagagcgtgcagattattatgaaaaagcaattaaaatagatccagaacgagaagaaggatatttagaattgcttgatctgtttgtctatggtgcggataaaaatgaacgtgattttaatcgtgacgaaacagcagagatgacagcaattcttggatataaaggaaccggaaacagaacaaacgaaagttattttgaaagaaataaagaaggatatgacgagtttgctttccgtatgggagtgtattacttctattattatgaaggaggcggaagcgcaggaaaatcgatggcacagccgtggtttgaaaaagcacaaaaaggaacaaccttagatgcagacaaattacagcttgcggaacgttttgcaaagatttccggatattatgcttctttagattcaagtgatgagaccggatatggaagttctgcttcttatggtgattattggacagaccttaccaatcttacagatggagatatcagcaaaatagttaacactaagactgctgttgcaatttacgaagaactcattgcacgtattaatgaaaatgcagttgatttcaaacgtgccggagttaccaaagaccagatgatggataaattgtccaacaccaaaacaagacttgaaatgcttcagaacgaaatttcacagagtgatgaaacctgggatgaagtattagatagtatcagtgcagcggaacatcaggtaagcgttgcattttccggaagagacacacagccggaacagaatcaggaagaaggaggaaatacgaatggaaagcagtgaaagactgattgagttatatcgtatgggctttattatttgtctgtgccttgcagccgtatttttactgctgagtatctttttctttttcaaattcagaatccgtgatgtgtttgatttcttaagtggaagagcagagaaaaaatcggttaagcagatggaagaaaaaaatgcgaagacaggaaagcttcgtgatgactattatgcagaaccgctgagttcagaactctataagacgccaagcggaaaagttgtgccgacgatgtatccgcagacagaaccaatgaataccggaacagagccgacacaagagacacagactaaaatgagtcagactccgacacagctatcatcaaatggaagcgaagagacgactttattaggaagcggacaagaagaaacaactctgcttggaaatggtgaaaccggtacagaagaaaccacacttcttggaaatcagaatcagaataaagaagaacaggaaataccgggctacaacggagagactgctcttttaactccagagatggaaaaagcaatacataaacaacaagaagagaaaaagcaggaagagaaagaaaaagaagtcagacgtaacaagtttgaaattataaaagaacagatagaaattcatacaaaggaagtaatctaaaattttgatagaaaaaataaggaaggagtgaaagatatgaaaaatccaaaaagaaatccagtggaaagattttgtgcattactgcttgcatttattatggtgtttacactggtactgccggatggggcattgagtgtatcggcggcaggaaataattcggatgaagcgttaggagaacctgaagcaagtaccgagaaaacaaccgatgttgaatttacgatttttgaaaatgttcctacgacagaaaatccagataacaaagttgcaattcaagctgcagatttgcagattaaagaggcaggcacagataatgtagttgcaaatggacaatctgatgcaaacggaaaagtgaaagttaaaaatctgacttatgatacagaaaaaagttatgaatatactgtatcaaaagcaggatatcaagcattagaaaacaaatccatatcaattggaacggtaaatgaagtcgaagttacattagaaatgagtgacattagtttaggagatttatcagctgtagaattatctccaaataaagaaggtgttccttctcaggttcaagcagttattaataacaaaattgataattttgaggttggaggagcagcacagtataaatgggaatcttccaatccagcagttgcagatgtagatggaaatggtttaatcactgctacaggaagaggaagtgcaacaattactgtatacagaaatggaaaaagtgctcagacaacgataaaagtaaaagaagttccgtcaatggaattgaatgtaactccaaatacaggaactgatgttaaaagtgttactatgacagtgactatgccaaaagatgcaaaaggcggaaaagtaacattttcattagaaagtggagaaagttatgaagttgctgttaatgaggaaggaattgcagaacaggttctggcgaaagatttaataggaaatgtgaaagtcagtgcagcgtattctggaaatgaactgtactttgagaatagtacagaagaaactggaaaatataaacaaaagaagcaaatttctctgacagctgatggtaagagtgaagcaagtattgattatggaagtgacttgccggtgctttctgtaggaaacgcagaagatagaacagtcacattttcatcttccagaccaaatgtaatagaagcaactccagatggtaaattaacggtaaaaggggaaggaactgctaaaattactgcaacagcagcagaaagtgataattatacagaatcaagtgcttcttttacaattggagttaatcaaaagccaattaataagaagattacatttgctgattttgaatggaatacaacaagtgcttctaaagtatatgataggagtagaaaaattagcattactggtactttaaaaagcgatgaattagtaggaaatgatcagattacagttacagtaaatgctcagttggaaaaatcagatgtaggaagttattctaaatttactgttatagatgatgattcagatattaacttaaaaggtacaaataattataagataacgacagacttctcaaataaaaatgttcagttagcagaaggtaaaacggttaatattactccaagaccagtttatgttaaggtggcagtaaaagaaggtaagacaacaaaatttgcgtacggaaaaagtaaagcatatttacagaaagctgtagaagaaaattatgaagtggtacttgcgggtaaatatgaagatggtaatatacttgagccggataaagatcagggactgcttccaccagctaaacttgaattaaaaaactatgcagaagtagcgttaaaaggttttaatgataatgatactgtgtattatgtaggaagttatacagcagaaataattcctgttataacaaacaaaaatgccggaaattatgaaattagagtagattctgaaaatattgcaaaatacagttcagatcttacgattgaaaaagaaacacagactagtttaaatgatttagttgaaattgttggtgcagatggaatttatcaaaatgagaaagatggttctgtatatataagaggaaatcaggcagcaacattaaaactgcaattcaaagaaacaaatgcatattatgaccagatctgggtttctaaaggtgaaaaacaggctgatggtcaggaaatttattacgatgccattaatagtggaatcagctttgatgatagcaaagataaagagtacactttgaaagtttccttaagaaatagtaaaaatgcattaacagtgacagatggtgttgaatatcagaagataacagtagatgccaccagtccgacagctgattttaaagacttaggaaatgcaggacagtttaataaagtacttccaaacgactggaaaggctttgggaatttttcaaaggataagacaaaagaatatcttgttacttctgatgatgctaccagtaaagtaaagagtcttaaaacctgtaaaattacagtggataatgatgaggcagaagcaattgtagagaagatttcagaagcagttaagaatgatagtgtatgggaagaaacaagtagtgtaaaattcgataaggaaggaaactatattgtacttgcacttgtagaagataatgttggaaataaagcggtttatgcatcaaatggtttggggtttgatttaactgcgccagatgtttcggtcaaaattattgaaccagaagaaaacactggatataatcaaaaagttaattttacagtagagataaatgataaagatattacgtctggtgttgatgaaattgaagttatagctatggattcagataaagatgtgactgatgaatatatagaaactgtaaaagtagcaggtggatttgatgaagataataaaatagttatcgactcttgtacacttaattcagagaaaataaatacaattgttgaaagtgaacaggatggaacacttaaatcaattcaagcccatgcgaattttactgttaatggaaaattgtctatcaataaatatcagtcaggatatgcaattgtaaaagtaattgtacgtgataaagccggaaatagtaaagcgataacaacaaaaagagaaaaggtagatgtagttgcgccaaaagtaactgtgaaatatgataaggattcggaaacttcttatattcagagttcagaacgaacaatgacaattacttatacggaaagaaactttattgaatcgggattaaggtttgatgtttcaattaatggaacagaaccagatgttcttacgcttaatgaattagaggatcttgaatgtgtaaaagaagtaaaaaaacctgttaattcaaaaaatgagccggatgactatacagacgaaagaacaaatacttatgaaattacgttttcaggtgatggggcatataaagtgattccgtatataaaagatgctgctggaaatgaaaatcaaggtattgaatatgcggatattaattcaaaagcaaatgaactgttcattttggataatacagcaccaacagtagatgtgaagtattcaccagaaaaaagtgttagagaaaacgaatattttaattcaaaaagaacaatgacacttactattacagaacgtaattttgataaaagtacattgaagtttgatttgatatctgatggtgaaacaaaagcagggttaacaaaagaagaacttataaagaatggcttagttataacaacaaaagatacagagtcaaaatttaatgaggaacagcatactgatgatagaaacatagtttatgaaattgaatttaaaaatgatggtttttatcagttaattccttatttaacagaccttgctggaaatgaatatgagggtttagctgaaagtgaaataacaaaatatcaagaattctgcatagataagaataagaaagcacctaaagtaacagttaagtataatgataatgataacaaactgaaattgcataatggtaagtatttcaatcagcagagaattgcagaagtaacaatcaaagagcgtaattttaatgcggatgatttagagtttactttaactagagatggagataagcaaacatataagggattttctgcattagagcaggcaattggtaagttgaaggattgtgatattacagaaattaaagacagtgaagaaaaaactgcaaaacaaaagcatacagatgaaagagaacatacattttctatcacatttggtaaagagaaagaggatcatgactataaaatttctgtaaaggcaacggatcttgctggtaataataatgatacagttaaagatgagaatataggggctgagacggttgcaacaggagaagagtttactgttgatatgctggcaccaactttgacagttaaatattatgtatatcaagatgaaaatggtaatgaatcagatgagaagaatgaaattgaaaaagatgagattgattctggagagtgttataaaaatgcatctattcatgcagaagtaataattgatgaacgtaacttttctgaagaaaaaaatggaaaagatagttttgcagagaaccagataaagcttgactattctgctaagacctatgatggaactgaagttaaaacaaccgattttggtgatgtagctaaagagagagaaaattggaagcctaaccaagagaataggaaagataatattgaaatgctcaatttagaattttctgaagatgcaaattatactttaagcattacatacaaagatcttgcgggtaattctatagatcctatgagttataagtctcagtttactgtggataaaactgcaccaactggaaagattcagataggcaaagatgaaaaagatgtaggaattattggaaaagtttttgattttatatattcatttttcacgaataataataaaacagagattactatggtaggaacagatacaatgtcaccaatagtagaacagaaatattatattgagaaaaatagagatataaaaaatggtaatacgggttatgaaagattaagcctagaagaactaattggtaaaaaagaatgggttgatacaaaaacaatagaagaaaataaagaaaatatagctacaagtacatttaaaatattagaagaaaactctaaggcaatcccatatctatatataaaagataaggctggaaatgaaacttacgtaacatctgatggtgcgatttacgatgatgaaaaagaaggaactcctgaaattcaaattacgacagatgatccaatatcttgggaaggcgaaaagaatgatataggtctttttaataagaatgtaacttttaatattgtggtaactgacccaaaagtaaataaaacttattcaggtatcaataatgtttcttatagaatttataaaaatggtgaatccgaagatgtaaaatatatttctctttataatgaaactatggacgaaccgataatgaaacaagtttttacttctgaagacttagtagttccatcagaaaagtttaacagcaatgatgttacaattgaagtaactgctacagataatgcgggaaatactgaaacagtaacaaaacaaattgccatcgataccacctcgccagaaattacagtttcctatgacaacaacactgtcgcaaatggtaaatacttcaaagcagatcgtactatgacaattgagtacaaagaaagaaactttgatgaaaagggacttacgtttgatgtatcaacaaatggtagtttattacagggaatttcattagacgaattaaagaaacttaaggataagggaattatcgtacaatcatttaatgctgctgatgatgatactgaatcgggtaaaaactttaaggattttacagatgaacgagttaatacttataaaattctctttaatgccggtggcaataacggagatatggattactcgattgttccgcacataatcgataaagctaataataagcagaataaagagacacagtataaagctggtacagaagctaaaacagaattcaccatcgataaaaaagccccagtcatctccatggcttacagtgcagagggtgaaacaatcaacccaggcggaaatgaagtttccagagtttacagaaacaaaacaattacagcgacagctaccattgaagaacgtaacttctccaatagtaatagtttttcagaagatccgaaacaaatgaacctcacctatagtgcaaagaacttccaaggttccgacatcaacaccgagaactacacaggcacagcaaacacaagaggtgaatggagtaccaacgtttacaccagaacaaaaaccttcacattctctcaagatgccaactacaccttaggtcttgtttacagagaccttgccggtaacgaagcagtctacgatacacgttacttcacagtagataaaactgctccaaccggaagcatgaccatcgaggataacagtggaacagccaagacctggattcagtggattcagcaggtattcttcgatatcttcacccagagccagaagggtgtatccatgacaagtgcggatgaaacagcaggtgtagcaagtacacagtactacaagtatcatccggattcagagagccgtcatacttttgacggtttatcaacacagaacttggattctatcagcagctggtctgatggatacagtacatctgttaatgcagatgaacaggttattgtatatgaaaagattacagaccgtgcaggaaatgtaacttacattaataaccaggaaggtgttatcgcagataatacttcaccgactgcaccggaaattaagattacggcagcagaacctgctcagggaatctacaatgcaagtgttccatttacaattgatgtaacagaccctgaaaatggtggaacttatgccggattaaaagaagtttcttatgaaattacaaacaacggcaaagtaacacagagtggtaactataacagtgatttatctgacccgacagcgagagtacataacattcatcgttctgaaacagtaaatgcagaactcaataacagcaaccatgtaacaatcaaggtaaaagctgtagactatgcaggaaatcagtcagaggcaaccaaggatttgaagattgatattacacatccggaagttacaatcacatttgacttaaataatccgctgaatggcaagtattataagacaacaagaacagctaccgtttctgtaaaagaacgtaactttgatactaacgcagttgatttgaagattacgaatacagacggaacaatgccttctgtaagtggatggagtatcagttctcaggctggtgaatccgatgatgcaattaatacctgtcgtgttgagttttcagcagatggtgattacaacatgacaatgcagtgtaaagaccaggcaggaaatgaatcaaatacagtaaaagtggatgagtttaccattgataaaaccattccggttatttctgtatcttatgataataattccgcagcgacaccgggatattacaatgcaaacagaacagcaacgattacaattaaagagcataactttaatgcagcagaagttaattcacagattacagcggctcttcagggaagtggtatttccgcaccgggcgttggaggctggagtaacagtggagatactcataccgcaagtgttaccttctcagatgatggagattatacctttgatattgactatacagaccttgccggaaatgcagcagcagattatacacaggacagtttcactgtggataagacaaaaccggaagtagagttctttgatatcgaagataaatcagcaaacaatggagttgtagcaccgggtgtgaagtatagtgatgtgaactatcttgaaagtggcgtagagattaagattgagggtgcagagcatgaatctaaagaactcaccggaagccgttccagtatcgcaaacggtgaaagtattaagatgaatgactttgagtatacacaggataatgatgatgtttacacaatgaccgcagtaatctcagataaggcaggaaacaagacagagaagaagattatgttctctgtaaacagatttggttcgaactattcgttctcagatacaacaaaagaattccttgatgaggtatattctaattcagcaaaagaccttgttatcacagaaaccaatgtcgattcactggtatttaacggaatttcttacagtctggataataagacaacagaactgaaacagggaacagattataccgtgaaagaaaccggaggcgaaggttcctggaaacagtatacttacacaattaagaaagagaactttgaaaaagaaggacgttacagtgtaacaattgattcagaggataaggcaacaaatacaatgaataacaaagtaaaagaacgtaacattaactttgttattgataagactcctccaactgttgttatcacaggtattgaggaatccagctatcgtgcagacagcagagatatgtcagtcaatgtatccgataataccgctgtaaaacgtctcgacatcatggtagacggaaaatctgtagcaacctatagtcaggaagatgtaaaagaagccggaggcaaaattgtttatacattgaacagctcaaacagcaaacagaaagtaaaagctgttgcggttgatatggcggacaatgaagcaacttctgataatcataatatcctgattacaaccaatctgtttattcagtatattaataataaacctcttttcataggttctattatagcgttagtgctgattgcaggtggtgcaatttacttctttgtatttagaagaaaaaaatctgaagatgcagcagatgcaaattaattagaaaggatggctgtctgaatagaaatatttgggcagccaactttttaaccagagtatgtattttgggcgtctgtcttaaagaatttaagacaggctccgagagtacatcaaagaaatttcacgaagataaaagaggatttggcggggaggtgatttgatatgcttcaaaatggagaaatacttggcgggatgtatcaggtcattggtgaaattggtaaaggtggttctggaattatttacctgggatatcacttacgacttcaaaagcagattgtgattaagaagattaaagatatcaatgtcggacagattaacaccagaatagaagcggatattttaaagaaacttcatcatagatatcttccgcaagtgtatgattttttagagatgcaggatggaatctataccattattgattatattccggggcatgatttgagttattatctggggcgaaactataatttcccggaagaaacaattttaaagtggatgcatcagatgtgtgaagtgttggagtatcttcattctcagaaaccaccgattcttcatagcgatatcaaaccgggaaatattatggttacggaaaatgatgatatttgtctgattgattttaacgtttctttggatggtgaagtatcaaaggagcttcagggattgagcagaagttatgctgctccggaacagtttcaatatgccctggatagaatgtatggaaaacacagcaaaatagtattagatgcacggatggatatttatagtatgggggctgtgttctatcgactgatgacggggtggacgccagatgcagaatcaggaatgccatattctattatggagatgaatcttccctacaataatggaatcaaagcagtgataaacagggcaacggcatgggaaccatcacatagatttcagtcagcaaagcaaatgagaaaggctttggacaatgtggaaagaatggacccacagtacaaggcattaacgaatctgcagattcttacagcttttggaagtggtttgttgatgctttttggtatctttttaatcttgtttggaacaatgtcaaataaaaaagaaaaatggcaggaagcttatgattctttttatgaaattacagaatccggcacagattccgaggttgtcacagagggaattgatttgcttaataatggttccgtacagggggcactaaaaaaatatccagagaaaaaggcggagattcttcatgcaatcggggatagttatttcagacaaaagcagtatgaagatgcaatcgattattataaagaggcacttgatacaggagaagtccaggaaaattatttaagagattatatgatggcgctggcaagaagcgggcaaaatgtagaacagtcagtgattgaaatagaatatccggaagcagcctatatggagcgggcagatgtggagttgatagaggcgcagacaaagtatacacagggtgagtttgaggaagcgctaataaagtgtgaagatgcattagcacaaagtacggatatagaagtcagcagtctgatttgtgtcttagagtcagaaatctatacggagcaggaagagtatacgaaggcggcagattcagcaatacgagtcaccaaatttgattcatccaaagatgcaagaagacgagcaggaagtcttgcttttgaagcgggaaatcacttagaagatacgaaagaaaaaaatgggtggtatgagaaagccaggaaatattatgaaacgctttgtcaggatgagacgtgttcgtatgaagatgaaatgaattacgcactggtacttcaggctctggagcagtattcggacagtaatgtctgtttaagaaagatgagagaagaatatccggatgattataaggtactgatgtggatgtgctataactatctgggaatcggaaatcaaaagggcagtatggctgaggtggaatctgatttgaattttgcatatagttcctgtaaatatttatattctcaagatgaaagtatgacaggtggttcagatgaggatatggaaaaattaaatgagttgatgaagcagttggaagaataataaaaatacaggaggaaattatggcaggaaacgttatgatagttgcaggcggcatactgatagtcgcagcaatcagtattatggttggtgtgaatatagtgttatcacgaaaaaaaaggcggataaaggaacagatttattccatgtatgagtaaagaacaaagaaaataaaaggatgagggaggacagcaaatgaagaaaaaaggttatatcatattgagcgtgatttgtgcagttgttttaattgcaacaggaattattctgggtgtagttatgaaaaagcagtcaaataaaaaaacatatacggcttcgattaaaacagcggaaaaatatctggaagcgggtgattatacacaggcggttgtagcatataaaactgcaatcgaaaaaatgccggaaaaagaaactggttatgtaggacttgcaaatacctatctggaacagggggatacttcttctgcaaaaattatcttgaaaaaaggttatctggtcacaaactcttccaaaattcaatatatgttgaatggaatcgaagatggaagtctgcttgtgaacaatctgaaagaaacacctaagaaagaaacgctccaaaagagtggagaattatcatttaatcaaaattttttccaaaagttagagagttttacctatcaggattatgaaagagaatatggtggacttccggaaattgtaaaagtaaaaaatggagaagttgaagtggtacataaaaatctttctgcaacttgtttttatgcaaatacctcagaacatggagatgtagttgatacaaaaactgatacaccggataaaaccggtatgccggaaaaaattgtagtggatgatatttctttattattcaagaattttacaggagaaattacaattgatgaacttcagagcatttgcggttccaaagtagatattgtgaataaaaaagagcgcagttatgtggaatttgagtctggaagtgctttgattcgaattgaaagcgatgaaaatggaacaatttcctcatctacggcatggaatgagattatccttacaaatgcgaataaaaaccggacagctaagaaaagtgtattttctggaattgtattaaatgcaatgacaagtgagggtgtagaggctgcaaatattagtttagaagcgcagggagattccagtcattcagcgaatataaagacggaaatggatggttcattttcaattgaattagaagcggatacctataatattactatcagtgcagaaaattatgaagaggaaacatttgaatttacaatagaagaaaatagtaactacagtggagagcagtttacgatttcaccaagtctggcaagtggaagtgcacgtatcgtgcttgaatggggagattatccggaagatttggattcttacttgataggtacgacggacgatggaacagaagtggatgttagtttccacaatgaccaatgtacaaaaaatggagaagtaattgcagaattagacgtagatgaaatggatggtcatggaccggaaacgattaccttaaataatttaaacggaacgtatcggtatttagtagatgattttacagaatcaggcaaattgcaagagtatggtgcgactgtaaaagtctatatttcaggtaagagtcagccggaagtgattacgatagctccagatgcaggtgtaaaaaacgtttgggaagtatttgaacttgaccatgggaaacttaatattttgaatcgtgcagcagtagaggattatgaataaagaggcttagtttatgtggatggtattggttatgctgattattgcactggcattatcagggatttttctgtggattaaatacagcataaaaaaatcagaggaaaagaaatattatgatgcggcagcgaggatgattaaagaaaattgtctgaataaaatcatacaaaaccgtgggcagagaaggcagacagtgacagataaattaatgatttatatcagcatatcaggaaagtccagacagggatttgtatttgacccggagaatgggattcgtattggaagaaacattgaggaaaatgaaatctgtattcgagatgcacttgtttcaagcagtcattgtaatatctacctgtatcaggggcagccgattatacaggattttaattcagcaaatggaacatttatcaagagaggattattcgataaacatccggttgatggatgggaatatatctattcgggagatacgctgttgataggggatacgaggatacagattaagtttttcttatttgatatgatgagattataaaagcaggaggacgacagaggtgatattgttaatttacaatcagaaaatgtgcagggagattcttttgcctaatcttcgagattctgattatgcgataagcatatctggaaaagcatatggattacgacaggatatccgactgcttttggagattacgggggttacctggaaaataaaagcagatgaaacttatcagttgcgaaaatcgggaatattttgtgaaaatgtggttcttgaagaacatgaaaagtttgtaatcaggacaaaacgaggagaagagctggagttgattgtggcagattcgggattgggctttttgacgttaggaaaatatgattttcgtcagatgagtcagatttcaatcggagctgcgccgcaaaacgaaatttgttatgagtttgaaaatttgatttcctcttatcacgcagaatttcagagacattcggacggctggtatgtggtggataaaagttcaaatggagtttttggaaagaatggaagaatcggtggaacctacagacttaattttggagagcatcttaatttatttggacttcatattatttttcttggaacgatgcttgctgttggtacctattatggtgaattgaaaatcgatcaggagcgattaaagcgatacgattttaagaatcaggaaaataatataccgtcaaacaaaacggatacggaagaaacggatacctattttaatcgttctcccagagatttttcctctttgtatacggaaccggttgagatagagggacctcctgccagaaaagcagcaaaacaaaagccctggtttttagttgtgggaccatcatttacaatggcaattccaatgcttttagggtgcggtcttgcaatctggggttccggaatgagaggaatggcatcgggagcttttatgtataccggtttgattacggcagttggttcttccggacttggtgctttttgggcggtaacaaatctgaaatatgcaaaacaggaagaaagcagtgaagaagaaaggcgtttcaatgcctatagcaattatttaattgatattacagaaacaattgaaaaaaagtataaatacaatgcagacatcatgcggaaaatgtatccggaagcgcagacttgtgccggatatgacagttctaatattcatctttggaatcgaaattacacgcatgaagattttctctttcacagacttgggcttggagaacttccatttcaggtgaaaattgatgttccgaaagaaaaatttacaatggatacggatactttgattgaaaaaccacagatgatacagaagcaatttgaaactttatatcaggttccggtaggaatttctcttttgaaaaaacagttgattggtttaattggaggaggaaataaaagaggagcgattgaaatcatgcattccattgttgcggaaatagcggcttctcactgttatacagatgtgaagtttgtttttctttatgatgaggaagaagacgataaaaaagtatgggaatctatgaaatggtttcctcatgtgtggtcagaagaccggcagatgcgatatatggcagcagatgaagtagaaagaagagatgtcttgtttgcattatccaatattttaagggcaaggatacaagatattgataatcggaaaaaaagagcaattccaaaaccatattatctgatttttgtttcaaatccagcactcttagagggagaacttctggcgagatatatttatgaaccggtaccggattatggaattacgacatttttaatggcgcagacagtctcacagcttccgaatacctgtgaagaaatgatacaaagtgataagacatttgaaggatattataatcttcaggaaggtccgatgcagagaaaaccgattcgtttagaccgtgtttccaatgacagtctggagcaaatggggcgcaggctgtctggaattaaggtaaacgaaatagaaacaacaagtgagattcctcagagtctggatttcttttcaatgtatggagtgcgaaagctggatgactttatagtggaagagcgttggaagaaaaacagaacttataacagtatgaaggcattaattggaaagaaatccggaaatgcagactgttatctggatattcatgaaaagtatcatggaccgcatggtttgattgcaggaactacaggttctggtaagagtgaaactttacagacttatattctttcgctggcattgaattttagcccggaagatgtatcatttttcatcattgactttaaaggtggaggaatggctaacttgtttgatggtcttcctcatatggcaggacagatttcaaacctttcaggaaatcaaatacgaagagcaatgatttcgattaagagtgagaatctgcgccgtcagagaatttttacggaaaatggtgtaaacaatattaatctttataccagattgtataaaaataaagaagcacaagagccggttccacatttatttattattattgatgaatttgcagaactcaaaaaagaggaaccggacttcatgcgtgagttaattagtgtagctcaggtaggacgaagtctgggagtgcatttgattttggcaacacagaagccgagcggaactgtagatgataacatctggagtaattcaagattccgattgtgtctgcgtgtacaggacaggcaggatagtaatgatatgcttcataagccggatgctgcatttatcacacagacagggcgtggttatcttcaggtgggcagtgatgaaatttatgaattattccagtccggatggagtggtgcaccttatgaagagagtgaggatggcgcagatgtatcggtatccatgcttaccagaacgggaaaagaggcacttgctgcaagtcgtcttagacgtttaagaaaagaagttaataaaagggatacgcaggaaaagacgcagctttcggcaattgtagaatatttaaaattaaaagcagaagaactgggctatcaaaatgcaaggcagctttggatgccggttttagagaaaaatattgtgttatcagaactggaaacagcagatagatcagctttggataaaggtgagaaatggagtctcgatgcggtagttggtttatatgatgatccgcagaatcagcagcagaagcctcttttagttgattttgcacagaatggaaatcttgcggtatgtggttctgttgtgacaggaaaaagtatctttatgcagacgatgctgtattcactgtttcaaaaatataatccggatcaattgcagtgttatatattggatttcagcagtcatttaatgactccgtttgaatcagcaccgaatacaggtggaattgtatatgacaatcaggaagaccggcttggcaaatttatgcatcttcttgagaaaatgatggaagagcgaaagaagctgtttgagggaggaaactatgcacagtatgttcgggcttatggacagaaaattccggcaattcttgtagtgattgacaattttggaggttttcgtgagaagacacggatgaaatatgatgatattattctcaaatatgtaagagaaggtaccggatatggaatgtatctggcagttacggcagcaggatatggaatggcggagataccgggaagaattgcagataatatacggactccaatctgcctggaacaaagtgatagattccgatatatggaaattttaagaacaacaaaacttccggtgtttccggaagccggaataccggggcgtggactggcagaagtagacggaaagatgttggaatttcaaactgcattatcggttcaggcagatgatgattttggaaggggcaggattttggaacaattcagcaaagaaaaatcagctaagtggactggaaaaagaccacttccaatacctgaaattccggaaaatccaattcttggtcagttggaaaaaatggagaattattcaacactggcagagggaagaaatcatattccatttgcttatgaattagaaacagcagaagtatttagcgtaggacttagagaaacctattgttatacaatatcaggacgtgcacatacaggaaaaacaaacgtattaaaactcttaatgtatggagcacagaaagcgggcggaaagctatgtgtaattgaaccgggacagaccgaactaaagaaaacagcacaggaatgtggagcgcaatatcttacagataccaagacggtatttgaatattttaaagaactgacaccgacgtttgtagcaaggaacaagaaaaaacgggcattgatagaggaaggggcagatgaagaaagaatttacagagaaatgtattcagaaactccggtctatatctttttaagtgatttgaaagagttctttaaattgatttacagtgctgatgcagaagtcggaaacatgtctggatttatggagacaattatggcaaagggaccgcttcacagaatttatttctttggatgcctgaaagtagaagatgcaatatctttgatgtcttataaagcatatcaatcttatatttcttataaaaagggaatccatttaggtggaaatttaagtacgcagaaaatatttaatttccagaatataccttatgcagagctttccaaagcaatgaaaaaagggtttgcttatgcggcagatgaagaagatgaaacaataggaattcagatcgttgtacctcttgcaaggagggaaaacatttgattggaatgttgatttcatcaatgtcagagaaagaaaccggatatatctgtgtgcgggcaaaagatatgatgggaagtatgagcgatgaaatgcttgaaatacataaatgccagacgatagagatgctgaaagagcttgttgagtctggtgagaaagcagatttagcctgtattgacattacaattccagaagcattagaacttactaaattatttagaagtaaaaatgaaacggcatatatcatattgattgcaagccttaaaatttctccggttacttatatgaagccgtctattcgtgctgaatccttgattttaaaaccgtttcagtcacaacaggtagatatggcagtgaaagaagcaattcaggaagtgcttaaaaagtatcagaatccagatatagataaggtgtttgttgtagataatcaagaaggcagagttttaattgaatacagtgcaatttattttttcgaagcaagaaataaaaaaatctatttgaatacaggagcaagagagtatggattttacagcacaatcgagcagcttcaagaggaattaggggaacagtttatcagatgtcatagaggatttcttgtaaaccagaaaaagattgaacgagtaatattttcaaagaatttgattcttttagcggatggatatgagattccggtttcacgtacgtataaatcaattttaaaagaatttcgtacgagtgtttgataaagaggagaaaaatgtctgaatatgagtatgcagaaagtggagttttgctgacttttcgggagcttactttgcttcttcaaagtgtgggagtaagatacataaacggtttttgtctgtcggagtctgaaatttccgatgaagaagtaattcaactgataggaagtctggttcgaaaagggattctaaagacttctgacacagaattttatatggaagatatggttgaaaaaatgattcgctgtattgggtggcctgatgaagattatgaaattgaacaggaaaatggacagatttattgttatgaaaaagaagaatatgcattggttacaaaaatctatccggtgagagagaaaactctggaacttattttatatagtaaagaagagtttcaacagaaaatcagaaaggaggaaattttgtgatactggtggatgttgaagtgcctgtgatgggaaagacttatgatgttcaaattgatgaaactgttccggtaaaagagattgcagggcagataagagatatgatttgtctacaggaacaatgtggaatcctgggcgggcaggaaaatctgactttatgggatgttcaaaggcagcaatgtctgatgggagaacatacagcaaaagaatatgaaattacaaccgggacaaggcttatgttggtataaacatggttattggtcagaaaatcgtgtcattcgtcagagatgtgtaacaaaaatagaaatcagtgataggataacattaacaacaacaaagagaaaaaaataagaaaaattggaggtagaaacatgggacagatggtaattggaaccacagaattaaaaaataaaattgaagagcttcgtgcattaaatacccagtttaaaagtgcagtaagtgagttggaaaatacagaaggtgctttaaatggaatgtgggaaggcgatgcaaaaaatacttttcataacgcatttatgagtgataaacagcagatggataatttctattccacaattgagttatatgcacagaagctggaagtgattcttgcaaaatatgtgcagggagagcagaaaaatattgagattgcaaatcagagaaagtacaaataaattttgaagaccaacattgagaatacatataaaaaacaggaggaaccattatggatggaatgattaaagtatcaccggaattattaatttcaacagcaggagaattttcaaatcagggaacaacaataaatacactgacaggagaaatgctgcagcttgcaacagggcttgcttctgcatggcagggagacggagcaactgcttatatcacaaaatttaagggattagaaaattcaattcagcttatggttcgcatgattcaggagcatgcaactgatttggaagaaatggcaaaagtatatcaggaaagtgataaagctgcagcggacgaagcaagtggtcttgttactgatgtaattcaataatgaaataatgataaaggctcagaggaaaagaaaaagtgattagaattgaaatagaaacgatgaaaactgctgtctctgagttacaaagaaaaagagccattctctcgaatataaaagagagaatggctaaactggcttatgcagtcagtcagcaatcttacgtggaagaaacggtatgtgagttaagaaaactgaaaaagcggatgggagaaattgaagaaaatctgagagatttacaagaagctcttgaagaaatttgtattttgatagaaaaaacagaagaaaaagtggtttcatattatgaagaagaacaacagaaacctcaatttacaagatttacaattcgatataatcaagagttgctgttaaatccgcatatacaggaacttgcacctatcaggctcaaaaatgaaggggaagcagatgagtaaagtaatagaaattgatacaaatgcattaaattcagataagagcagtatgtcagaagaattgcagcagatacaaaatgaattgaagtcactccaggacgaaatggagacaatgaatagctggtttaccggaccggcagctgcagcgtatcaaagtcatatggaagaagaaattgaaaacgcaatgagtgtatgtacttatcttacagagtatatgaactgcatagaacaggcttcaagagcttatacagagtgtgaacaatcagttgcaggtgtggtaaacagaatcagaatttaaggagagaagcaaatgagcgatgttcaggatattttgattaaagtagagccagagaaactggaagcgttagccggaagagtaaattcaaaaattaaggcaatcaggggacggtttgagcgaattgaatcagaggtaaataactcgaatcattactggaaaggcgagggaggagagactcaccgaagagtttaccaacagtcgaaagaaggaatcgaagaaagtctggaaaattttaaaggaatggtatctgcattggaaacaatggcaggaacttatagaagtacagaaacggaagtgataagttcggcagatggactcccagcagacgtaattatatagggaggatgaaaaatgggattattgaaatttgattttaataaagcgaacgcacaaattcaggaattagaagaaattgcatccgaaatagatcagctggcagctacagactatgagaaccttatgcaacaaatgcgtagtgcatggaaaggaagtgcggcagatgcttatataagaaaggcaagtcaagtgcaggagagaataaaaaatacatcacgggatattaaaaaaacttcggaagtctatgccaatgcagtgaaaagagtacaggcagcagaggaaaaagtcaaagaaatcgcaaaaggaaaaagctgaggttaacagtacatggaaatacttgtattgattatatgtgcagtaataattgtagcggggattgtgttgattatctggattttgagaaatcgttatgataacagcaatgtagtaatacacggtgggatggatacaggaacacaaaaaaacggaacagaatcagggagtttatttattggagtttcaaatgaacttggaacttctgtactaaatggaaaaaacagaagaagaacgtaccgtttttatttaatagatatggaaaaaggcgaaaaatatgatatacaatttcgtgagaatataggaattggaagagcagaaaatgtaagaggaattgaacgttttcttacaattcataatgacatgagaatatcaggatatcattgtaggatttatgcatttaacagtcagatttatattgaagataccggttcaaagaatcatacttatgtgaatcaggagcaggtgacaagacctcatgttttaagaaataatgacgtaataagaataggggatacaaggctgacagtaaaattttagaggtgctgaatatgaagaaaacaatattagcaacaatgatagcagtctttttgatttttgaagggagcgggtgtggaatgataaaaccagtatcgacacaggaaaaaattctttctgtgatgaaagaaaaatatggagaagaatttgaatttgaaggatgggcgcataaacagtatggaagccgtgatatgacagccaatgttacctgtgcttcatttccaggagaaagaatacaggcaggtcaggaagaaaatgaagaaggaaagatgatttactttgatgattacatggcttatcaaaatgaaggagagatgcagacaatacttgagaatttagtacaagaagtatatccgaatgcacgtgtaatctggaaaatcagttcttcggtgtttcccagagaaatgtctccgggaatgagtgtcaaggaaataatggaaagtaaagaatcggtattttctgcttatattgtagtaaatcaggcggtaaatgaagaagaaaaatattatgatttggagaaattaagagaattattagaagaaaacaaaattcgtatgaagggtgcattgttttttgctttagatgaagaagcatataaagcgctggatggagagaattactcttattgggcatcaaaggatggctggtttgagcagaggtgtaattttgcaattgatcaggcatatgaattttattatgcaaattggaggtaagagatgggaaatgcaaatgaaacgtattctgctatttttgacctctttacttattggggttattcaatggaagcggaacctggaaaaacattaggagagatattacaggaagctttagataccgggaattcgagtgaagtttattatcagactttaaatgatgcaattaaacgttatccggagcttgcaaatgcagaatttaagagtcccagctggcagcagggaggacggtatcattcagaaacttacgcttgtgtctttgaattaccaaatggagataattatattgcataccggggtacagatgatggtggatggattgataatggacagggcatgactcaggaatcaactttattgcagagagaagcgtcagattattttgatcagatggcagagcaatatggatggacagaatcggataatatttatgtgacaggacattctaagggtggaaataaagcacagtatgttacattgatgtccaatcatgcaaatctggtggatgaatgtcattcttttgacggacagggattttcagatgaagcaattcagagctttaaagagaagtacggagaagaaggatatcaggaagttctgaaaaaaatgtatgggtacaatggagcaaatgattacgtaaatccgttggggaatactatcattccaaaagaaaatatcaagtatatagatacggttccaaatccaggtagtgggtttgataagtttgcaggcttacatatggaagagcagatgtttcagagggatgaaaatggaaatgcgatagcagttttaggagaagaaacagagcagggagtgatggggaaattctcagctttcttatccgaatttttgatgagtttatcaccggaagaaagagatgctgctgcaatgtttgtgatgcagtttatggaattaagagatgtgggtgaaggtggtggagcattaggagtagatggaacttcgctgacatcgggtgatatctacctgtttattgagagagtattaccgaaactgctagatgcgatgctggaggaagtactggaaaaattcggtcttgataaagaggcggcagagcgtttaattcttttggtaaaattatggatgatttttgcatcaggaaaatgggagtataagttagtcaaagcattgattgacgaattgaaagaacggttattagagttagggcatggatatgagctggcagcgaaagcattagattctcttgaaaaatggattaaagaaaaaatagaattgattaagagctggttccagaagcaaaatgacagctcagactacagtagtttttatgttgaaaccagccagttgttacatttcaaagaagaattagcacagaaaaaaacacagctggaggaaaaagcaaatcaaatccgtgaaattcgaaaaagggttgatttcggaaatataacacagcagtatatttattactgcttggtatcatctgccagaaatcttgaaaatgaggcaaaagcagttaatagattgagtaaaggacttcaaaattgtgtgaaagtttataaacaaaatgagcaaaaggtaataggaatttatggaaaatgtggtggatgatttcacaaaaatcacaacaaaaaatgtcaaaaccctcttctaaatctaacttttttcctttaaaatggcaatcaaatggttgacgttatatggaaaagagggatgctatgacaacttcagaccttgtaaagcagatgtgtcaggaagaggggatgagtattgttgccttagccagagaactggggcagtctcggcagaatttttataagaaactgcaaagggatactttgacacttacggaattaaaggaaatagcgaatgtgcttggagcagatttttcgcgatagctctgtactaccacaaaagtaattatctttcactgacaactgtcctaacacacaggggaagaaaaaagcctaaaagctttctaaaagttggaaaagttgaaaaaatacggtaaaaataggttggaaaaattgaaaaaacatggtaaaaataggttggaaaagttgaaaaaatgcggtaaaaataggttggaaaaattgaaaaataactgtataataaagttgaaaaagatgtaaacttattatacggaggtgcaaaatgttggagcgtttggcaaaaagaaagattcaggaatggcttaaaacaggaaaagatgcatttatgttaactggggcaagacagattggaaagacatatttgattcgtgagtgcttaaaagaaagtggatttccatatgttgaaattaattttatcgaacagccacagcttgtagatgtattctcaaaagcaaaagatgccaaagagttattgatgcgtttaagcttaactgcaaatggaaaattgaaaaaaggaaaaacaattatatttctagatgaagttcaggaatttaaagatatcgttacaagagtaaaatttttggtagaagaaggaagtttccgatatattatgagcggttcattgctgggagtagagttaaatgaccttcgttcagcacctgtgggttatatggaaatatatgatatgtatcctatgggatttaaagagtttgcacttgcagtcgggataaacaaagaaatttttgaaatgctggaagagaaatttaaaaataaggccgttgtagatgaatatgtacattctaaactgttggaagtgttttatttgtatttaattgtaggtggaatgccggaagcagtagatgtgtatcttcgcacgaatgacctggaaaaagtagctcaggttcatgagaaaattatcaggttatataaacaggatttttctaaatatgagattagatataagcttaaattgcgtgaaatatatgatgcaatgcctggacaactggaccagaaaaacaagagatttcaattaaatagtataggaaaaggaatgagttatgaccgggttgaaaatgattttctgtggttgaaagatgctggcgtggtgattcccgtatacaatatagcagaacctaaattaccgctagttattagcgaaaatagaaatcttttcaaattgtttttttcagatgttggtttgttgaccagcagatattccaatcaggtaaaactggcaattctgaatcaggataaatcgattaacaatggcgctctttttgaaaatgtagttgcacaggaattgcttttacatggacataaagaatattatttcaacagtaagaaacagggagaacttgattttgtaattgagctaaatggaaaggtgactccgttggaaataaaatcaggaaaagattataagagacattctgcattaaataacattttgcaaaatcaagattaccagattgatgaagcactgattttttcggaaggaaatgtagaaataaacggaaaacgagtgtatctgccaatttatatgattatatttctggaagaagcgaagctagagaatacggtttataagctagacttaagtggattaaagaatatctaaattgaaatttaaagctgaatatgcaaaaaaaaacaaaacaaaagagctggagggttacgtatccaatgccttaactaaatgacattgaagaaaaaggtactctcgtttcaccgtttaccaaggaggtccaccatgttcattgattcccacatccacctttcccatccatcctactccaccccatttttatattactctccaaccacccattccctttcaaccaccacgcgctcaaacctaatcgaggagtttcgttctgccaaaatctcagcagtcatcgagcctgcgattgagttagaatccaatgaacgacttttagacctcagcagagagtatccagattttgttttcccggcagtaggagtgcatccgacaagaacgccacagacgccttggagtgcgagaaagcaggttgaggagtggtcaaaggataaaaacgtaattgcgattggtgagctggggctggattatcaccatgctagaagagaacagtatcggttaaagcaaaaactgtggtttatctggcagattcttttggcagataaacgtaatcttcctgtcattttacatattcgtcttgcggacagggatgccattcggattttacgattctttaaaaagaaactgcatggcggagtgtgtcattgttttacaggagatgctgaaactgcaaggatttacacacaggaatttggttttctgcttggaattggaggctatcttttacaaggaactgagacgagcagggcattagaagaagcggtgaaagagacacctttggaatttcttgtgctggaaaccgatggaccgtatgtaaaaccaaaagcaccggaggggatttccggaaagcagtggaaaaagagcagaaatacaagtctgatggttccggaagtggcaaagcgtattgccgaaatcaaaggaattgatgtagaggaagtagagcaaatcacgacaaaaaatttcaaaacacacttcaaaatttaacttttttgtcttaaaatggtaaccagatggttgacgttgatagagaaaaataagtgaatgattcgaagggggacattttatgactacatcagaccttgtaaaagaaatgtgtcagaaacagggcatcagtatcgctgcattagcaaaaaacctgggacagacacggcagaatttctataaaaaactgcaaagggacaccttaacacttacggaattaaagcagatagccgaagtgctggatgcaaattttgaacagctttttcgtatgccggacggcacaaagttttctttgaaaagtgagaataaaaaacgaacggtcttaccgcttgttggcagtgcgtttgagccgggaggggcaaaagaggcaattgaaaagttacaggataaggaactttccgagattgcgcaggcggagttgtattatttttcggcacaggcggaaaactgtgtgaagattgtggaaaactatctttccagtgaggatattatgttgagactttcggcagatatgctgtatacctttgcaaatcttacgcttggaaatgcaaaggaagcgcagagttccagagaagacgtctataagtgtttaaaatgggtatttcaggagggtgagacaaacgagaaaaaggcatcctgtgtctttgcgttttatgtcatcagcatttttattcacattccaccggaagaaaatattccgcctttggaaaaatatattccatatctgccaattggtcagcgtctgtttgcgagcagcctgcttgcacatgagacttatcttagaatggagtatgccaaagcgcagggaatcgttcagtctgcgatgttgatgtcggacggaacctatccgatatcgatgatttatttaaattgtgtggctgcgatgtgtcagattaatttaagagagcaggaagaagcgaaaaaatcagtttcttttgcgtgggaaatggcaagaaaagatggatttttagaaccgtttatcgaatatcatggcttgcttcaaggggtattagaggcctgtgtcagaaaaagtgagccggaagtatataaaaaattagtagatggagtgattgcatttagcagaggctggatgaagattcataatccgaagatgcaaaaggcagttacggatttgctcacaccgctggagttctccattgcgatgcttgcctgccgtgactggacaaatcaggaaatcggggagcatctgggattgtcggttaatacggtaaaacattatgtttcgagaattttggaaaaacttcatattgataaacgggataaaataaaagaatttgtaaaccagtaaagagatgtgctctcggaacctttattatacctgcttttacagagtgtctgtttcgtatgatgaaatacgaaacaggcacttttttgatgtcaaacgggcatgtgaaacgaaatccgtttttgataaaattaatgtcaaagatgtaatggttattgagcgaaaaattacctttcaaaagcaaagcaaggaaagaatgcgagagggaataattcaaagaaggggaggggaaatatgaagaaacgtctgattagtatgctgctgagtgcagcattatttgtcacatctataccgatgccggtttctgcggacaatcaagtaaatgaagggaatgcgagtaccgcagtttcaagtgaaggcaatcagggtgaaactcaggaaaatggcattgattataagatgaatggcggtgcttttacatcggggtatgaagcaccggacacttatccggcaggcgaactgccgacagaggaaaatattacaaaggcgggatacgagtttggcggatggtatgaggatgaaaattttagtggggaacgcattacatccttagatacagcagatcattccggagctatcgtactttatgcgaaatggatcgagcgttattattatattgatattccacagacggtatcggcagatggcggtacgctttctatttcagcaaaagcaggtggattttacgacaaagattatgtgagtgtgtcagttgcgtcagaaaatgactggaagctgaaaaacggaaagcatgcattgggttatgaactccgaggggaagagggcggtacaaagctcgaaaacaattcgcttgtaacaagtttaagtgcagaggaaaataagacagaggagaattttaactgtaccgtaacggatacaccgagttatacaggggaatataccgataagctgacgtttgatattgcatttgaagagacacgttataccgttcattatgagacaaacggcggtacgcagtatcaggacaccaaaaatcaagcaggcgaaaatgttgcattaaccgaccagtcctttccggcaggaacggcccttacaaatctgccggagccggtcaaaaaatctgcaacatttatcggttggtgttatgatgcggaatgtaccaagtatgttgacagtaaggacaggctgttaggcgatattacgttatatgcggcttataccgatacccagccgttagatacggtcacgatggaaacttatgcgagagcgtatgatgtggcaacggatttcaccatttcgattaccgatacgagtggaaaattaacggcagaagaacttcgacaggcatgtacgattaagaatgtaagtgacccttcggaagaaattgtattaagtatcatcgaaaacggcgaccagacatttaccgttggaaaggaaaacggatggacggaaggtgcttcttacaaactggaattaaaaaacaatgcgctgtattttaccggctatgacacaagcatccgtgagtatgattttacagtttataaggcagaaattgaaaatgcaaagttaagaagtgaacttaagtacattcatacaaatgatttaagtgatttaaccgtaaatggtcagaaagcaaaatcagtttccgtcgcagttatgacagttggggcagatggttccgtacaggaagagggaagtgaaacttccggaacatttacttataccaaacagaaattaagtgttggagataagattgcagtctattcaggtgatgtgattccgacgatggaactgtcgtccggagaaaacagtgatgtttccttttttgaaattacagcagtaaatggaacgtcttacagctatcgtggcgctgaggcagaagatgtattatttatgccggacgtaattccgcttcttgctgagaaagataaggatggagatctagacaataacagtgcgacagttgctgttagtgatttgacctttggcgatgacgaaatgagtcaggcaatgaatcttaacagtgagacaacaattgactccggtgattttcttgcattttatacggacattaacagcgagacacttttctatggggagattcaaagcgttaccgtttcaggggaggattacatattagactatgtgcctgtttcgtgggaagaaattcagatagcaatggatgtgtatcgaacagagaaagtagatggaaatgaacttttagaagataccgaccgtggcgagtttgaagatgaaatcgaacagcaggcagttgagagtggatttgcaaatgaagtggtagagcggattgccgaagcagcgatgcagacggagtcctttgaagaattagaacaatccttgtccagtgatttgggcgcgggaatttcattgcagccgaatacaaacataaataaaatcatgccgtttgcaggcggaaagcctggtcgtgtgaccgcagagcttgatcacgtaaaggcaaatcttggaacgaccttaaagcattttgatggtgatatcagtggtgtgcgcatggcactcgatatcggtgtgaagattaccatcaaagttgcacagggcgcaaatattgaaattttagtgacagcgacatttgaacaggaagttcgtgtcaacattaatgtaaatggaaaagcagtctggaagagatgggggattttcccgtatattgcagattatcgagtaacggcatcctttgatttatatgaatataccagaatcggtttaaatgtaaactttaaggtcgtagaatccggatttatcgataatggctcgaaacttagaaaaggtgtcaacaagataacagaagaacttaagagcatgatggaaaatggcgaggattatcttgcggataaatcgaaattgtcaggaagtcttggtgattcaggagatgatatttcggtttctaagagccttgccgagcgatattcggaactgttagaagaagattcagactgggtggaaatctataaccgcaagctgctggaacggcatttccgtgtcttattaattatcgatattgaagtacgtttagactttgtagtatctgcaaatgtcaatatttcaatgggtatgagttactggtataaaaatgcaaaacgttatgtgttctgtgtaaaagtaaaagacagaagcgcaaccagtgatacgattgatttatgtgaagaacaatacgaatttaccgcttatgcgatgggaacgcttggacttcgggcaggagtaaggcttacaatcaaagtgggtctgatttctacgaaacttgccagtgtggggatctccgcagaagtcggtggatatgcgcaggtttggggttatctgtattatgaattaaaatatgcggcatcgacgggacggcagaccagggcaatgggtgcgatttatctggaaatcggtatttatcttgaaattaaattccaggcgcaggcacttgccaatgcatttacttacagtccgactttgtatgaaaatgaatggccgctttatcgggttggaagtcttgagagcgtcctggattttgtatatacgcagaatgaagttgaagagattagcatgaagcgtgacattcagtcggtacagctttctgataattacttcaagatgcagtacatgcacatgaaagatggcttaaacgatggaaaatattttgaaaagatttatgatgataattcaaaatactttaacatcgtgatgacaaatccggcatttagttatgaccctgcgacaaacatcatcagcgttgacccgcaaaacaaaccggaacaggatggagaaatgataattacctggaagaaccaggagggcacatttaatacaaaagcgattacaagaaagatttctctgcactgggataaacttcgggatggttattacattgcattccagagtaacggcggttcttatattgaaacaattgtaggaaaatacaatgttccgattcaggcaccgaaaaatccggtacgtttaggttacaatttcgcaggatggtacagcaatgaagaactgaccaaaccgtatacgattccgacaaacatgccggacaatgatgcattggtttatgcaaaatgggaagcagcggatgtggattacacggttgtggactatatggaaaagacaaatggtgtctatgaagcgcagactccggtgaaatataaggcaaagacaggttctaaggtgacaccgactccgacgaaacggacaggatttgagactccgcctgagattaccgagacgatacaggcagatggaagtacggaaatcgagtattattatgcgagagaacagcataaaatcacatttgaatctgagggagaaattctctcacagggaatttataaatacggaagtctcatgccgacaccggcggtatatcgaccgggatatgaatttgatggatgggacagcgaagttccggaaaatgttccggcagaagataagacttatcgggcaaaatggaaaccattagacggtattgcttattctgtaaaatattatatccagaatccggatggagaaggctatgaagtgggtgaaatcaagaccttctccggaaagacagcagaagaagtgactgcaccggaagcagattatgatgaggcagtttaccacttaaaagggcagcttccaaaaggcaaagtaaaagcagatggaagtctggtattaaaagtttactatgatttaaatgaatataaactgacatatgacccggatggcggaacacttgacgagacagaagtaagtgcaaaaccaggcgataagatttcacttccggtaccggttcgggatggatatacctttgaaggctggtatttagacaaagcacatgagcagttatttggcggaacgatgccaagagaggactgcacagtttatgcaaaatgggaaacacagaaagtaaattatacggtaagacatcttcaggaagtggttcataacgaagaagtcgaggcaaacagcgtggaaatcgatccatccattgcggaagaagaaccaatagaagagaataattttgaattagtggaagaagaagtattctctgcaaagacaggtgaaatggtaactccggcagtgaaaagttatacaggatttactgcgccggaaaccgttacagaaaaggttttaggagatggaagtcttgtcattgaatatcgttatcagagaaatatgcatgagattaatctggtatttgatggcaaagaaatcattcgttactggcttcagtatggcgcatcgattgttgagaccccgggaaggatgggatatctgtttggcggatggtacacggatgatacttatcagactgcatttagcggaacgatgccggacaatgatttgagcttatatgcaaaatgggaaccgacagattccgaatacatcgtacgacattacaaacaggatcttcctgcaatcgatgaaaagacttatacgcttgtggaagaagaagtgaaaactgcacttacagacagtgaagtgacaccggaagtaaaaacttatgaaggttttgtttctccatcggcgaagaaagaagtcgtaagtccttatggagataccagcattgaatattattatgatcgagtttccagtccggttacttatgtacagaataatggagaagcagacaaggttgaagatactttatttggtgaagaaatttcctatattccaaaacaatccggttatgcatttgtcggctggtatttagatgaagcattgactaaaccgcttgagaaggcagaaatgccggcacacagtctgaaactttatgcaaaatgggagcttggaaagaaatcctatcgtgtcaaccattacattcaggaagtgcgacttggtgaaaattatgaactggctgagagtgaaaactttatcggcacagcaggtgaaatggtagcaccggaagttaagacttatgagggattcacctcaccggaaaaacagtattatgaacttcaggtatcggatgacatggaagtgttcaattattactatcagcgtaacagttacaatgtgacaatagacagaaacaacggcagtgagaatattacattagaaccggcgtatgaatcaaaaatcgaataccgtccggaaaagatgggttatcagtttgcaggctggtatctcgacaaagagttaaaacaggaatttggtggaacagttccggcgaaagatttgactctgtatgcaaaatgggaggcacaggatgtttcctacagcgtgcgccattatctgcaaaatgcaaatgatgacggatatacctcagcaggtacagagagctttacagcaaagactgacagcagtgtgacaccggaagttaagacttatgcaggatttacctcaccagagacacagacagcaaccgtaacggcagatggaacattaaatattacttaccgttatctgagaaacacccataccttgacagagaaattctgcgatggcagggaagataagattcagacgatgcggtatggttcagcgattgcgggtgtatcaaaagcgggttacacctttgcaggctggtatttggatgagaactatgaaactgcatttaccggaacaatgccggatcaagacctgaccttatatgcaaaatgggaagcaaagaaaatcaattacgtggtggaacactatcaggaaaaggcagatggaaatggttatgttttaaaagaacgtgaaatcaaaactgccgataccgacagcactgtgacaccggaagtaacctcttacacaggatttacctcaccacaggtacagacaaagaaagtagacggcgcagagatgacagtgattcagtatcactatacaagaaatgttcaccgtctgacctttgttcttgaaaatggagaagcagataaggtttctgatgttcgttatcagagtacagtgactgcaccaaatccaaaacgggaaggttatacctttgtcggatgggataaagaagtcgttgagacgatgccggacaatgacgaaacttatacggcagtctggatgaaaaatacttacacaatccgctttaacacagaaggcggaaatgaaatcaaagaaatgactctggaatatggcgaaaagattaccaaaccgaaagatccaacacggaaaggttataactttgttagctggaacattgaaattccatcggaaatgccggcaaaaaatctgatgtgcaccgcagtatggaagaaagaaacttataccatcagctataacttaaatggcggaagtgcttctaatccggcaagttacgatgtggaaagcagaccaattcgtctggaaactccgaaacggacaggctatacatttaccggatggagcggaactggactttccaagaaagaaatgaccgtgacgattccaaaaggttcaaccggaaaccgcagttacaccgcaaactggcaggaaaatacttacaccatctgctttaccacctgtggagtcggcacaactggttcaatggaccagataaaaatgaactatactcagacaaaacaattgccggataacaaatttgtttgtaagggctacaccttcatcggatggtcttataaagcaaatcagaccattgcatattatagagaccacgcatgggtaagcaaactttcggatgcaaataatggtgttgcaaccttgtatccggtatggaaagcgaacacgtataaagtaacctttgattacggatatgataacaagaagtcagaagttaactgtgtatacaacaaaaattattcgcttccacagaatgtaacaagatacggctggtcctttgaaggttggaaactgaaaaatgcgacagcagtaacctataaaccaggcaagaaaaatgcaaaacttgaagatgcagaaaatattgtgttgcatgcaagctggaaagcaaataattcgtacagttatcgtccatcaagttcgtcaaacagatatctggttacggatgaccatgaactgactaaatttacattctatgtggatggaaatcagacttctgtaaagacaaccggcgatacgggacaaaatccggcaagatatcatctgaatatgacgaatctttcttatcaggcagttcataatagctacagcaagatgaagataaagataagctttaagattacgatggaaaaagatggatatgcagatttaagagtttcttatcattccagaacacaaaataagacttatgaaaaatggaaaaccgaagtagaagacatcaaggcgaagaacggagagaccgtaacgtatacttatacaaaagacggcaccgatgcagataatatcacattggaatttgacgcacatggaaaaaattctgataaatattatctcagcaacttaaatgtagacgttacttatgagtagtgagcaagggggaagtgcagatgaacggcaaaaataaaacaaataaaatactaatcggaattattatctgcctgattgcagtgattattggaggggcaatttattttacaagaggtacagacaaagacaaggaaaataaaactctggattcggctttcgagccgaatctggactccaacgcaagcgagactgcctcaaatgacgggaacaatgaagaagctgataaaccggaaggaatccggattccgggatatccatcaattacagttccggcagatacaacagacatagaaatgaatctggaaaatccggccggaaatccatgctactttacatttgaactggtgttaaaagatacaaatgaaactctgtatacctcgaaaatggtagaaccggggaaagcaattacgaacgtaacactgtcgcatggacttgaaaaaggggaatatccggctgtgataaagatttcgacagcatcacttgaggatggctctgcaatgaacggagcaaatgtagaaactaccttgattgtacagtagtaataatatgcgctcggagtcttcaatgcacttacttttatggctgattttttgccagctgtacccgaattttatcaaaaaattaggcacaaaaagattccgaacgcacataagaaaggaaagacaggaggaacactatgagaagaaaatggttttttgccggaatcttttttacagtgatgcttgccaatactgtctatgcaaataatacgacaacggtaagttatacagtaaatccggcatatacagtgctgattccggtggatacagaagttgaatttaatcagttatcagaatcatttggaaagattcaagtagaaaaagcacagcttgatgagggaaaatgcattgaggtttctttaagttctgacggagtattgaaaaacaaaaataatcggagtgatgtgattccttatcagattttaaagacgagtgaagcgacaccatttgtgtcagcgaggtatcacacggcaggagaagcgacaccgcttaccatcagtattaaacaagatgactggaacaaagcaccgtcgggagattactcagataccgtgacatttacgatttcctacgtggatgataaataaatgagaggggaagtattatgaagaaaaaaacaattatggcagttttaataggaatgacagtcataatgacacaacagaggattatcgttttagcagcaaccacttcaggtgatcggcaaagcagtaccgttagtgcaactgtaccggataaacatacgattacaatcgataaagatgcgcatgttacgattacttatgaggactcaaaagatgaaggggagggagatgcatttccgatagaacgcttttcaactccaacctttacgattgaaaccgaagacggatgggagattgataaaatccttttaaatggcgtagatatcaccagtcagctgagcaataaaaagctgacgctgccatccgtttatcaaaatgagacgctgaaaatttcaacgaaaatcaaaccggcatataccgtagtgattccacaggataccaatgttcagttcaataaattgacagaaaactttggaaaaatttcaatggaaaaagtatggttggaagatggaaaatgtattgaagtatcgatgagttccgcaggaaatctgacgaaccagaaagattcaagtaaattaattccatatcagattttggaagaaggaaaagatactccgtttacatcagcaaaatatacggcgcagggagaagaaacttctctgcttatcgacattaaacaagatgactggaataaagcggcatccggttcttactctgatactgttacgtttacaatctcttatgcagacagtgaatgatggacgtgtctgatttgtcatctactgcgttagcgtcaatcaccgtagctccgctacgtttcattccgctgccttgtatatgaaaaaatcattcaacgtcaaatatcaatgtagtagagatttgctatacattatacttgtgaattggaggaggataatgtgaagaaaaaaatcgctgtgctggctggaatctgtatgcttgtcagtgtgcagggaacggtttttgcagccgataggaattcgcccgatgatttgtcagaccagacggttcaaagcgtaattcgtgcagacgtgcccgattcccataagattactgtaaaaggagagcatgttacggtcagtcttgagggaggaaaccaagaagaaaaccaagaagaaaacagtattcttgtagaacggttttcagaaccaaagttgaaattcagccctgaaaaaggatggaaaataaaaaaggttctgctcggagatacggatgtcacaagtcaggtaaaagatggaataatcactttggcatctgtgtatgaagatttgatattaaccgtcgagactgaaaaaatcaaagacgaatccggcgcaaaaacagattccaaatcaaacacaagcttcggtcagaaaacaaatcaaaacaataaaaataatcagacaagcacaacaaatggaacaaaaacaactgcaaattcaggcagtgcaacaactgtgggacagggaatcaaagcagccgtgacagaagatgaaatgaatgtgggaatttatggaatcggagcggttgcagcaggaggaatagcagtgcggtgcttgaaaagaaaaaagaaaaaaatctgatttttggtatattgcaaaatggaaatggaatatgccataatgccaataggcaaagagatacaagtcatccataggtgacaaaaaacgaaagagccagaggtggggtagacctctggctctttctattccaatttttgcagcaatttatctcttttctcaactaacaaattaaactattgcttgtgatacacaaatataaatggtactataaaagagaaaagactcctaaaaaaattaagaaaggggcaagtttatgggaagagaaggagaagttaaagtaaagagtctgcaaaaagcaatggaagtattagagtgctttatacaaaagcagccgcttggagtaacagaaatcagtgaaaaactggggctgtataagagtaatgtgcataatattctgatgacttttaccgcacttggatacttaacacaggatgatgaaaccggaaagtttcatctgggagtatccgtaatgactctgagccgggcatttcgtgaaggacttgatattacaagagtcgcagtaccatttatgcgagaaattgcaaatgaggcaggagagctgatctatctgacaattccaaaagatgacagtgtaatctatctggaaggaatttcaccggatcatcaaagaatggtcagtaaatcggttgcaggagaagactgtaagatgtattgcactgctgtaggaaaagcgatgcttgcaagtatgccgaaagaagaagtcgaaaaatgtatttcagggaagcttgaagcgtatacagaaaatacgattacagataaaaaaagtctcttagaagaaattgaaaaaacacgaattcgaggttatggaatcgatgatatggaaatcatgtttggcattaaatgtgtgggagttgcactgttaaatcatgatggaaaagtggaaggtggactgagtatcagcgccccatcgcttagaatgagtgacgagaaaattgaattatatgcaaatatacttaaggaatatgccgcaaagatacaaaaaatgttataaacttgtgcaagtttactgaaaaataaaaaagcagaagaaaaatattgaaaaaaaacacaaaagatggtaaagtagaattatcaaataaagaacgtagttctctaataaagaacagatgaaagaggaacccgacaggaagtcgggtaaaaaaatgaacgaaaataagaacactgttctgtaatagagaacaaaggaaagatttagggaggataaaaaatggcaaacaaaccgtatgtagtagtggaatggaatgacacagagacagatgcaaaaggatggatgtgtgcgtacaacttcgttggacattattgtggcggtggaacaagaatgcatccgacagtaacaaaagaagaagtaattcgtctggcaacaacaatgggatacaaatataaagcatgtgaatcccagacaacaggtggatgtaaagcaggtattgcttatgattacaaagctccagatgcactcgatgtattaaagagattcttaaccgcaactgctccttatattaacgcaggtgtttccatcggtggagacttaggtgttgattattcagacgtacttcgtatcttagatgaactgggaatcggaattcctcagacaaaagcaatgaaagaagacccagatatccatcagggaattgtaaaccatgacagagcagaaaaagaattaacctatgacggatttaaaatgtatgacatgattaccggatatggtgttgcagctgcagccgatgaagcctggaaattaaaaggcggaaaagaaggcgcaagcgtagtaattcagggattcggatgcgttggtgcaagttgtgttaactccttatataacatgggttataaagtagttggtatcgcagatgtaaacggactggtttactgcaaagacggattgaatattccaaaattagttgaaacaagacttccaaaaggtgaattaaaccgtgaagcgtttgaagataattatgaagttcttccaaataccgaatggatttcagcagactgtgatatcttaattccggcagcacttgaagatgttatcaataaagataatgcagataaaatcaaagcttctcttcttgttgaagcagcaaatattcctaccactccggaagcagatgaaatccttcagaagaaaggcgtagatgtagcagttgactttatttccaaccttggtggaattcgtatttatgaagctgttattttccgtattgtaaaaattgaaaatatgaatgatgaagaagcagcaaaagcaattgtagatgatacagtaaatctgattcgtaaacagactaaacttgtatttgaagaagcagcaaaaaccggagaatttacaagagacgttgcaagaagattatttacaccggataaatctgacacaccggatatgtaagaaaaaacttacagaaatacaacgtgaaagaagttgggggctgtcggaaagacagccccctttttcagtttatgggatgagaaacattctaaattaggaaaaaagaggagggtgtttatggagtcaaaagcgagaaaatatttgaccattattgcattagggcttgcaggaggttcaatttatttcattccttatgtaaaatatgtattttacgatgcacagcttgcggcaatgggaattaataatacacagtcaggtttattgctgaccatgtatacgattggaaatatggttctttatattccgggcggatatctggcggataaggtatcaacgaaaaaagctttgattatatcgctggtagcgacatccgttttaacgtgggtttatgcattttcattaaattttgtcgtttctatgattatatggcttggtctttcctttagtacagcctttgtattctggtcagcacttatgaaagcggtacgaattgtaggaacagaagaagaacagggattcatgtatggtttatattacgcttgtaatggaatcgcagcagctttaacaagttttatttctctgtatgcttataatacagcaggcgaagacattaagagcggatttgtacgtggtgtaaatgccagcggagttgttgttcttatcgcagccatctgtttagtattcttaatgaaagaagatgcaggaaaagttacaacagaaagtgacgatgataaaatttctcttccaatggttggaaaagttttaaaatcccctgttgtgtggattttatcaatcgtaatcttatgtggatatggattaaaatccagtgtttcttatttcaatccatatttaacagaagtagttggtgtttcagcggttaattcaggtattttctcaattattaataattatctgttgttattacttgcaccggttggtggaattttagcagataaggtatttaaatcaacatgtaaatggttgagtgtgtcatttgtgattcttgcagtattattcggtggagttttattgattccatctgacatcagcccgatggtagcaagtatttatactttacttccaggggcagttacaatgatgatgtatggggttgtattttcatcagtcagtgaagcaggtatttcaaggacaatgacgggaacggttattggaatttcatccattattggttatattccagattccatttattccgtaatatttggtaagtggttggataataaaggtgcagcagggtatacaaatatctttattttcctggttgcatccggaatcgtaggagcagttctcgcattttggatttatcgtcatggtaaacgtgcacagcatgatgcgtgatgcattagtaaaaatatatgaaggagaagcaagttatgggtaaagagaaaacagaaaaggtgtatacaaacccggtaagatgcaaaggctgcggatattgtattaatgcctgtccgcaggaagcaatcagtgtttccgatcatgtaaatgcaaaaggttataacacgattgtagtagatgaagaaaagtgcgtggtatgtggtatgtgttatcgtgtatgcccggattatgtatttgagattagataaggaggtcagtcacttatggcgaaggtattattaaaaggaaatgaagcgctggccgaagccgcattagcagcgggctgtcgtttttatagtggatatccgattactcctcagacagagattctggagtatttatcatggagaatggaagatgtaggtggagtatttattcaggcagaatctgagttagccggaattaacatggtgcttggagcagcggctgcaggtgcaagagcacttacaacttcatccggtcctggattttctttaaaacaggaaggaatttcttatttggtagcagcagatttgccggcagttattgttgatgttatgcgaatcggaagtggtcttggagatattgcacagggtcagggagactactggcagcttacaagaggtggtggtcacggagattaccatacactcgtacttgctccggcttccgtacaggaaaatgcaaacatgatggcagaggcatttgaccttgcagaaaaatatcgtcatccggtgttgattgcatctgatgcagcgattggacagatgattgaagcagttgaaattccggaatttgttgagcatgatatcaataaatttgactggaccatcaaaggatgtaaaaaaggctgtgaacagcgtaaaattcagaacgtttattatacacatcctgattatgaaggctatttatcctctaaatatgcacagatggaagaggaagaacagcgctatgaaaatattcaggtagaagatgcggaagtggttctggttgcttatggaatcagttcccgtgtaagcagggaagcagttgaaatcgcaagagcacagggcttcaaacttggtttgattcgtccgattactttatggccattcccgaaaaaagcatttgaagaagcaaaagaagcaaaagcattcttaactgttgaaatgaatattttaggacagatggtagatgacgtaaaacttgcaacagaaggcaaatatccggtagatcattatggttctatctttgaaattcctgaaacagatggaattattgcaaaagcaaaagaaatgttaaaaaagggggagatataatatgagattagtagctcctgaaacgattacatttacccagagtggtttttgtccgggatgtggacatggtttagcagtacgtttgattgctgaagttatggaagaaatgggcttaagcgaacagcttttagcagttgtagacgttgcctgtggttcattaaatattgactcctggagattcgatacaattatggcagcgcatggaagaccaatcgcaacagcaattggtgtaaaaaaagttcgtccggaaaatccggttatggcatacatcggtgacggtgcagcttactcaatcggtatggcggaaaccatgcatgcagcacttagaaatgataatgtagtgacaattgttattaacaacagtttatatggaatgacaggtggacagtgtgcaccgacttctcttccgggacagattacaacttctacaccaagaggaaaagatccgaaaaaagcaggtatgccattccgcgtagaagaagcatttaccggttttgatattgcatatctggcaagaggttctatggcagatgcaaaaggcatgatgcagtcgaaaaaatatgtgaaaaaagcatttgagaaacacatgaagggagaaggattctgccttgtagaattattatctccatgtccaaccaatctgaatatgactcctgttaagagtgtggaacgtattaaaaacgaaatgatgcagtacttcccactgggagaatttaaagataagaaagaggaggaatagacattatggcaaaagaaattatttgtgccggatttggcggacagggcgtactgacagccggaatgcttttgatcaacgccggtatggaacaggataaaaatgtattgttctatccttcttatggttctgaaatgagaggtggaactgcaaactgtacagtaaaaatcagtgataaattaattgcaagtccaatttccaaacaaccggatattttatttacgatgaatacaccggcaattgacaaatttgaagaaagattaaaaccgggcggactgcttctggtcaactcatccatcgttccggatgacagaaaatatcgtgatgatattaccgtagtaaaagttccggctactgacattgcagtagaagtaaaaaatccaaaaggtgcaaacctggttatgctcggtgcacttgctgcccacagtgacttattctctattgaatatatggaaagcgcaattgtttctttctttgagaaaaaaggaaaaggtaaatttaacgagaaaaatgttgcctgctaccgtcgaggtgtagaaggaaaataaaaactggaggtaacgggaaatgaatttaaataaactgttgaaaccaacatccgtagccgttatcggtgcaagtgaaaaagaaggatttggtggagatgtttgtagaaatattttaagttacgtggaagatagaagccatgtgtattttatccatccaaaaagagacagtgtttttggagttccatgttataaatccatcagcgatgtacctgaaaatgtggatttaatggtaatctgtacttcacagaaaacagtaattccgcttttacaggaaggcgcaaaaaaaggcgttggcggagcagttgtatttgccagtggttatggtgaagttggaacagcagaaggaaaacaaaatgaagcagaactgattgcagcagcaaaagaactcaatattgcggttatggggccaaactgcgcaggttttgtgaattatattgataatgtacaggcattcgcatttatctctgcaaaaagagacagaaaaggaagcgttggtgtcgtgtcccagagtggtcagctttgtctttccatgatggatgacccgggaatgcgtttctcttataatatttcagcaggaaatggaaaaatcgttcaaatggaagattatatggacttccttgtggacgatgaagatacaaaagtagtcagcatctatattgaaggtgttaaaaatgcagataaatttgcagctgtattgaaaaaagcagctgaaaagagaaaaccggttgttatcttaaaagcaggacgaagtgcaaaaggtggagcaatcgctgcttctcatacaggaagtctttccggctccgatgcatcctttgatgcagtattgaaaaaattcggagcaatccgtgtagatgacctggaagaattaattgcaatgtcactcatgctttctactatgaagagaatgccggaaaaagcaacatttgcttctatgaacttatccggtggagagacaggaatttgtgccgatgtaggaagcttaaatggaatcgaatatccggatttcaccgaagaaactctgaagaaattaaaagaacagcttccatcttatgcttctccaaacaacccgctcgatatgactgcaagtctttcttatgatgcagacctctatgcaggagcacttcggacggttatggatgacccgaatatcggtatggtactgattggatatactctgcttcttgaaattgcagacccgtgtatccattacatgtataaaggaattgaaaaggtagttcaggaaaaaggcggtaactgcaaaccgattgccatgataccatttgcggagaacacaagaaatcctgaatatcaggaaaaattattccagataggcgtaccggttttaccgcctccggtatacgccttcaaattactccgccatctggctgactttatcgcttatgaaccggagacaaagactctggaacttgcggtaggacatccgaagagcgaagaaacacaggcattatctgagcatgaaagtaaacaggaattaaaagtatacggtgtaccggtaccagatgaagtcatcgtaacatcgaaagaagaagcagctcagtttgcaaaaaatcatccgggtccattagtaatgaaagtagaatcagctgatatcctccataagagtgatgtgggcggtgtaaaattaaatgtttgtggtccggaaacagcagaaaaagcttatgaagaaatcatggaaagtgtaaccgcaaagagaccggatgcacacatcaatggaattctgacagttccaatgttagatgccggtgtggaaatcatcataggcgtaaacaatgacccgcagtttggaccgatgatcatggttggaatgggcggcgtctttgtagaagtctttaaagatgtagccttatatccggcacctctgaaagaagaggaagcgcttgaaatgttgaaatcactgaaatcatttaaacttcttaatggatatcgtggaactgagaaatgtgacataaaagcattgtgtcagacaatcgtagcaatcagcaattatgcccaggccaataaagatgttttaaaagagctggatatcaatccattgtttgtatatccggaaggtaagggtgtcggtgtagcagatgctctgatcgtaaagagaaaataatgtattagctagtccatttggtaaaaaataaattcagagatatcccgtagaagtcaaagatgacagactacgggatatttctgtttttaagagaatgtgctctgagagtacataaggaaatttagggggatatatgattcgagaaataaaaaaagaggaaattgcggagctcattcagaaagtagatgaattaggtaggtatttgacaaatcatccggaagtaagtggagaagaaaaagagtcatgtgaatacattacgcagttcctgaaaaaagagggatatgaaatcactgcgccttacggagaaatgccatattcttttcgggcagtggataaagaaaaaaaacagtttcatggaaaaaaagcggtttttttatgtgaatatgatgcgttgccggaagtggggcatgcttgtgggcattcttacagctgcgcaatcagtattttaggagcattattgttaaaaaaattttatccggatcttccgatgcgaattgatttagttggcacgccgggagaagagtttgttggtggaaaatgttatatgactgaaaatggagcatttgatgaatatgaatatgcagcaatgattcatttatataacagagattctacatattttgaaattcttgcatcaaatgatagatactttacgtttcatggaaaagcagcgcatgcatctgcgttcccggaagagggggttaatgctttgaatgcggcgcgtttatatatggaagcaatggacatgtggagacagcatattacaaaggattgtcagtttcatggcattgtagtaaaaggcggagaagctccgaatattgtaccggaggaagtttgcctggattattattatcgagctgcaacgctggaaaatttatggaagttaaataagatctcagaaaactgtgcgagaggtgcggcactggcaaccggtacagaagtggagtggcagcagagatatccggattatggagaaatttattggaatgaatatatggatcagattatgaaagatatttttgaacatgtaggaagaacttgtgaagattctccgggacctggaggctcttcggatattggaaatgtaaatttgaaaattcctgtgtttcatcctttactggatattacgggaaaagataaaacgtgtgttgtgcatgatcgtcgttttgaacgaattcttcatacaacagaaatgcaaaaagcactgtatgatggtgggaaaatcctgtatgaattgggatatttgctggctacaaatgaagaaaagttaaaaatcataaaagaaatgcacaaaaaatatagaaaattagtctgaaaaaggttaaaatatataaatgtatgcagcgggggacattggaataggcttgaatacgaaagggggcagtttatgcgaaaactatttgaaaacatagaaaagaaaatatttataccggcgtttttggtattaattgtactgacacttacgatttatctgtttccaggtcaggtaaacggagtgatttcgattttattttcactttgtacccatgagcttggctggttgtttatgctgacctgtctggcatcatttggatttatgatttggctgacattcagcaagtatggaaagatcaaacttggaaacaaagatgaaaaaccacagtacaataatttgtcatggattgcgatgttgtttacagcgggggttggaacaagtattgtaattcttggatttttagagccgatttattatgtgagtgcaccaccatttgatttggaaccgtttagtaatgctgcatatgagtatgcacacatgtatgggcagtttcattggggcttcagtgcatgggcattttataatccggcgattgtggcaattgcctatgtgatgtatgtgcggaaagaaaacagtatccgcttgagcaacgcctgtcgaagcgtgcttcataaaaaatcagatggatggcttggacacattgtggatattcttgttgtattcggtattgtaggttcgatttctacatctcttggaatcggtgcaccggtgctttctgatattatccgtgaagtgtttggtatccctgcacagtatgattttactgtaaaaattattgtgttgattatctgggtattaatctttggaacaagtgtgtatctggggttggataaagggatccagcggttaagcaatattaatgttgtgctggcatttatttttatgggactgattcttttgattggaccgacaatgcagatttttaagatggaagtaaactcaatcggtttatatgcatctgattttatcaagatgagcacttatacagatccatttggagaaggaaaattctccagtgagtggacggtattttactggggatggtggattgcttttatgccgatgatgggaatgtttgtcggtaagatttcaaggggaagaactatcaaaaatgtaatgtggggacagcttctatgggggacactcggatgctgctgcagttttatgatttttggtggatattctctttacctacagcagtccggaaaagttgatttggcgaccatccttgcagaagaaggaaatagcggtgcaattattgcaattttgcagacccttccaatgtctaagattatgatgctgttcttgtgtattgtctgttttgtctatctggcaacaacgattgattcgtgtgcttatgtactggcgggaacaacgacaaaacgcttatcctataaagaagaccctgcaagatggaatcgtatcttatgggcagttttattttgtgtcttatccattgggcttatgattattggtggattggaagctgtaaaaacgatttcggtgttgacgggactgccactgattgcagtgttgattgtgctgatggtttcagtgaaacgaatgttgaaagaagacgaagaaaaggaagaaaaaaggaaatagaaaaattttaactaattaacattcaagaatagccgcttagtttaggagacgtgggcggctatttttgtgatttatgattatctttacctatttacttataacagtcagtttcaatttttctaaaaataatcactgttgaaactctcaggatatgattcaataaacttaacaataaaaataaagctgagaaaggggtttataaatgataaaggttataaaaaatcatggaaaaacagtgcatgcatatcgcctgggagaagacagtgaaaaaattcagcaattaataaaagagaaaaaaatcattccgcttccgaatgataaattcgaagtgaaatcctcagaaacgctttcaagtcaaagtgagcatggtgaaattgcaaaggcaggagatttcattaaagtggacagtgatggtaatccctatccaaatggtgcagaatggttttatcgaaatcacagacatttggcaggagatgaatatgaacagcttccgcagactttagacgcctggacgtgcaatgagaaaatgtgcagggagattgagtttttaattcaacataaaggacttgtaataaacgaacaagaggaggcagattattttgtagcgccactttggggaacaacagagactgccgcaaaggatgctgtaattgtattttacggaattacatatacagagaacggtgaaattatggatgtggagtttaattttgtcaaacgcacagaatttgataaaacctaccatatcacggaataaaaaatctaaaaaaataatgcgtttttactgcgagttttagctatatggctagtgtacaaaatttgataaactgatataataaaattacgaatatatacgtaaaaaaataaatttgtgcgaaatcagcagaaaggaaggtattattatgggtcttattaaagcgggagttggagcgataaatggagtattggcggatcaatggaaagagtttttctattgcgaagcgctggataagaatattctggtaactaagggacagaaacgcattggcaaacgttcctctaatacaaagggcagtgataatattatatcgaatggaagcggaattgcagttgcagacggtcagtgtatgattattgtcgagcagggaaaaattgttgaagtctgcgcagaacctggagaatttacttacgatcgttcgactgaaccaagtatttttacaggaaaactgggtgatgggattaaagagacgtttaagacaatcggcaaacgatttacatttggcggagataccggaaaagaccagagggtttattattttaatactaaagaaatcatagataacaaatttggaacaccgaatccattcatgtttgatgtggtaaataaagacatcaatatgagaagaactgttcaggtgcgctgtaatggtgtgtattcttataagataattgacccattgttattctatacacaggtttgtggaaatgtagagcgtgagtataccagagaagagattgaccatcagttaaagacggaatttatcgatgccctgcagccggcatttgcggcactttccgaattggaacttcgtccggcacagattccggcacatacaaaagaattaaaagatgccatgaatcgtgcattaaagatagaatggacagaacgaagaggaattgaagtacaggcgattgccttaaatccaattacactcactgaagaggatatgaagaaaatcaaccagatggaggatgcagcaacactgggcagtaatccatttatgatggcaggacgtatgacagatgcaactgcaaatgcaatggaaaatgcagcttctaatccaaatggggcaatgaatggatttgtcgggatgggcatgtcgatgaatgcaggtggagcaggtgcaggctttggcgcagcgcagagcttttataatcagggagttcagcaacaacaggcacagcagcagatgcagcaaatgcagcagaccgagcagcagacagcacagaatcaatccgggcagcagtctcaggatagttggaaatgtgcatgcggagcagttgtaaccggaaaattctgtaccgaatgtggagcaaagaaaccggaaccaattcaggcaggaagatggaaatgcaaatgtggagcgatggcaaccggaaagttctgcccggaatgtggctcacctaaaccattagaggatggatggacctgcacctgtggaacagtaaatcagggaaaattctgccagaactgtggagcaaagaaaccatcgggtgcaccgttatatcgctgtgataaatgcggatggcagccggaagacccgaagaatccacctaaattttgtccggaatgtggagacccttttgatgagaatgatgttcagtaaaaaatatattttaggctcttttgatatttaatttgtgaaaatatttttgatgattgtgtcagaatttctaaagtataagtaaatgaaagttattacatcataagaaaagagagggggaaactgcatgggaaatttacaggaatataagtgtccgtgttgtggaggcgcaattgagtttaacagcaaacttcaaaaaatgaaatgtccatactgcgatactgaatttgaaatagaaaccttacagggctatgaaaaagaacttcaaaatgaacagtctgacgatatgacatgggaaacttctgccggaagtgaatggcaggagggtgaagcagaagggcttagagtctacacctgcaaatcctgtggcggagaaattgttgccgatgcaaatactgctgcaacatcctgcccatactgtaataatccgattgtgatgaccggacagtttgagggaagcttaaggccggattatgtgattccgtttaaattagataaaaaagcagcaaaagaaggtttgatgaaacatttaagcggaaaacggcttctgcctaagattttcaaggaccagaatcacattgatgaaattaagggagtgtacgttccattttggttgtttgatacagatgcagaggcacatatccgatatcgtgcaacgaaagtgagaagctggagtgatagcgagtacgattataccgaaacaaaacattatatgattcacaggggcggaaccgttgggtttgaacgaattccggtagatggttcctctaagatgccggatgatttgatggaatcgatagaaccgtttgattttaaagaggcggtaaaattccagatgccgtatctggccggatatttggcagataaatatgatgtaagtgaggaagaaagtgttgggagagcaaataagagagtgaaaaaatcgacagaaaaagcatttgcgtctactgtcaaaggttattcttctgtgacaacggaaaacagcagtatacagttgcaaaatggaaaagcaaagtatgcgctgtatccggtttggattttaaatacgacctggaagggagaaaaatatctttttgcgatgaatggacagactggaaaatttgttggaaaccttccggtggataaagcggcagcaggaagatggaccgcattgcttacagtgatatttggagctttgagttatggcattatctggctgttttggttgtttggtgtgttatagagggagggcggaaaaatgaagaaacgaatttttacagtttttttaaccatacttctttttatgctttccacagtgggagtctgggcgtcagagggatcagatgacagcggattttcaggggagtatgaacgtctgactgatgcagcaggattattaagcgaggaagaagcacagaatattttgacaaagctggatgaagtaagtgagcgtcagaagtttgatattgtaattctgacagtagatagtcttgaaggcgcaacagcgacggagtacgcagatgatttctttgattattatggctatggatatggcgaagggaaagatggaattttattcttagtcagtatggaagacagagactgggcactttcaacacatggatacggaattactgcatttacagatgcaggatgcgattacatagcagaacagtttaagagttcactttcagatggtgaatatgagaaagcatttgaaatttatatcgaccagtgcgatgcatttgttacacaggcgagagaagaccgcccttacgacaattccaatcttccaaaaaaaccacttggaatgatatggattccagttgcactggtgcttggatttatctgtgcattttcaattgtaggaggaatgaaacgacaattgaaaaccgtggcaagaaaaacaacggccggaaattatcagaaaaaaggcagtctaaaagtgacagaaagcagggatttattcttatatgaagatgtaactcgtacagcaaaaccaaaatccagtgatggggattccggaagcagtacccacacttcatcgtcgggggaaacacacggcggaagcagtggaaaattctagcaaattgggctgaaagttagtctttcaaaggggagtatataagggtataatgaaagaaaaattaagactgattttgttagagaagggaaattatgacatgaagattgcaattttaggtgctggaagaatcgcagtacatatggcagaaacactggctggaatggatgatgttgaggcttatgcagttggagcaagagaacttgagcgggcagaggcttttgcagagaaatatggatttacaaaggcttatggttcttatgaagaaatgctggcggataaagaaattgatttagtctatattgctacgccacattcccatcattataaacacgcaaaaatgtgtctggaagcaggaaaaaatgtgctgtgtgaaaaatcatttaccgtaaatgcaaaccaggcaagagcactttttaaactggcggaggaaaaaaatctgttaatcacagaggcaatctggaccagatacatgccgtcaagaaaaataattcaggatattgtggaaagtggagtgattggagaggtaacttctcttactgcaaatttaagctatgcagttacagaaaaagaaagaatccgtaaaccggaacttgcaggaggtgcactgcttgatgtcggagtctatccgattaactttgcaagcatggtgcttggtgaaaacctcaaagatgtgcagtcgagtgcaatttttgaaggcggcgtcgatattctcgaaaccattattatgaattttgaaggaaataaaatggcaacgcttcagagtggtgtcagagaaatttctgatagaatgggaagtatttttggaacaaaaggctacattcaggttcaaaatatcaataatccggagaagattacagtatttaaccagaaccatgaagaaacagcaagctattttcctccaaagcagattacaggatacgaatatgaagtccgagcttgtaaaaaagcattggaagagggcaaaattgagtgtccggaaatgcctcatgctgaaacggtaagaatcatggagattatggatggtttgagaaaaagctggggatacgaaattccggaagtgtactagacttaaataagtatgttataaagtgataaaacaaatgtccatacagacagcaaagcaaaatccccgatgttgccgcatcggggatttttacgctctagtagaaaatgtcaagaaagatttaaaaattttgattctgtcagtcgccttttaagactacacgaattctcttatagattaaaaatacaatcaaagaagtcagtgtgtatttaaataagttaaatgggaaaataatcaaggctgcaaatgtcagaagattatgaacagaaccatgaacggcacttcccatctgaataaatgcatcaaccggcattccgaatgcttttccgtaagccggaagcagaataaatgcattgataaagcaggctacaacagaggttaaaagtgttccggcaatcattccgagaacagcatgttttctatttttcatagaacgataaatgaaaccggccggaacaacgaaagcacatccaaagataaagttggcaacatcaccgacaccggctgtcattgtaccctttgttaccagatgaactaagattttcacaagttccacccagacacctgcaagcggtcccattgcaaaagaaccaactaataccggaacttcagaaaaatccagctgataaaaacttggtgctaaaaaaggaatcggaaattccagattcatcaaaattcctgcgattgcaccaagcatcgcaatctgtgtaattgttcttgtacgacttcttgtcgatacatttcttcttaatacctgttcactcatttttcgtttctcctttaaaacttatgattttattaagagaattctttgaaaatttcttagtctatagcatatataacaagtttccataaactaaaaagcccttggaattttttccaagggcttgagcacgtatttaaaaatttgcgcgttcttctctcatccagactatactgtcggtttcggaatttcaccgaatcagccgcttgcgcgggtcgcggactataccgccggtagggaatctcaccctgccccgaagaattctctttttctttgtcctcattatactatatatgtattctggtttcaatagtgaatctgtttttcacagttcgcttgaatttacctttgtttccgagtataatgaaaataattataggatgttttctatttctataagtgagaattgaggaggaacttattatgattaagtggaacaatttaaacactctttcttcatttgagaatctttcaaaagtagaacgtgtaaaactcgcagaggtaatgtcaggagaaaacggtgcagaccgtgtgaaaaaatacacaattcctatggcagccggtctttcttacaattatgcagcaaaacaggtagatgatgatgtattagaagcattaaccaagttagcggaagaagcacagcttgcagaaaaatttgaagccctctacaatggagaagtcatcaacacaggagaaaaacgtctggttcttcatcacatgacacgtggtcagttaggtgaagcagtagaagcagatggtgtggataaacgtactttctatacagaacagcagaagaaaattgcagattttgcaaataaagtacatgccggtgaaatcacaaatgcagcaggcgagaaatttacaacagtagttcagattggtatcggtggaagtgaccttggtcctcgtgcaatgtatctggcactggaaaactgggctaagaaaaacaatacatttaagatggaagcaaaattcatcagtaatgtagacccggatgatgcagcagcagttttgaattctattgatgttgcacattctatttttgtattggtttccaaatccggaacaactctggaaacactgacaaatgaatcttttgtaaaagatgctctgaaaaatgcaggcttagacgcatccaaacacatgattgcagttacaagtgaaacttctccgcttgctaagagtgatgattatcttgcagcatttttcatggatgactacattggcggtcgtttctcctctacatcagcagtaggtggtgcagttttatctctggcatttggcccggaagtatttgcacagttcttacagggtgcagcagaagaagataaacttgcaatgaataaaaacgtcttagaaaacccggaaatgcttgatgcattaatcggtgtctacgaacgtaacgtattaggatatccgagtacagccgttctgccatactctcaggcactgagccgtttccctgcacatcttcagcagttagatatggaatccaacggtaaatctgtaaaccgttttggtgaagcagtagattatccaaccggtccggttatttttggtgaaccaggaacaaacggacagcactctttctaccagttactgcaccagggaacagacattgtaccgcttcagtttgttggatttaaaaacagccagattggtacagatgttgtaattcaggacagcacaagtcagcagaaactctgcgcaaacgtagcagcacagattgtagcttttgcatgcggaaaagcagatgaaaataaaaacaaaaactttaaaggtggacgtccatccagcattattatcggagaagaactgacaccggaagcacttggtgcactcctcgctcactttgaaaataagattatgttccagggattcgtatggaatgtaaacagctttgaccaggaaggcgtacagcttggtaaagttcttgcaaaacgtgtccttgcacatgaaacagatggcgcattgaaggtattcagtgatttattaaacatctaattctttaattttaaatttttaagagaaagtctgtctgtatagaaaaatcttgcggacaggctttttttaggatgaatgtaaacttataaaaacaaaacggttgacatttaattcttttatggatatactaaattttatacgcaaaaacatcgaaaaatgagaggaaagtatattatgtcagaattatccatcacattacgtttagaaaactgggacgagagcagaccgctgactcgtgaggaagctgttgaaattttaaatcttccggaagaggaaatgccaaaacttctggattgtgcttacgcacttcgtacgaaatataaagggaaaaaagtcagtgtacagctattaacaaatgtgcgtagtggaaactgttcccagaactgtgcgtattgtgcacagtctcgtgattccgaagctccgattgaaaagtatcgcagagtttccgatgaaaaattatacggagataatgatttggtggatgaaaaacatctggcaagacattgtattggcttaagtggaatcggtttctccgatgaagaaattgaagacttggcagatcgtatccgtgaaatgaagaaaaaggaaacacagatttgctgttccatcggatttttaacagagaaacaggcaaaaatgttaaaagaagccgggctggaccgcatcaatcataatttaaacagcagtcgttctttctatccggaaatctgcaccactcatacttatgaacagcgtgtaaacaatattaaaatgcttcagggcttaggttttgaaatctgtagtggcggaattattggaatgggcgaaagcaaagaagatgtagtagatatgttgatggatttaagagaaatcaatccggaatccgtaccgattaattttttacttccaattccgggaacaagactggcagacagagatatttcagaattaacaccggagtattgcctgaaggtgctttgtcttgcaagactgatgatttcaaaatcagatattcgatgtgcagcgggacgtgaagtttatttcaaaggaattgagccgactttatttaaagtagtggattctatctttgcttctggatatctgaccgcaggcggacagggaatcgatgcgacaatgaaaatgatagaagaagccggatttaccggagaaattgaatcgacagatgaagagtaatagagaatcataaagcccaataaagaaataagggaaaagacaaagaagctgaaaaaatcgtttctttgtctttttttgtgctataatcaaaaaaataaaaaataaaaaaacttacaggaaggacgaaaatcattatgaaagaaaaacaaaccggcagttgtgaaagctgtacctattatatttacgatgatgaatatgaaagttatctttgtgatgtcagcatggacgaagatgagtatatgagactggtttccgatacgcattatcagtgtccgtattaccgaaatggaaatgaatatgcagtagtaagaaaacagatgtaaagaacagtagtaacaatatagaagcagaaaaaagcgaatagtaatcacgttagaaaaagaggagagagcgatgacaaaagatttgacgacaggaaaaattatgccgatactggtaaaatttacggtgccgcttgtccttgggaatttatttcagctgacctacaatgcagttgacagtattatcgtgggacattttgtcggaaaagaagcacttgcggcagtcggaatctgcaatcctgtcagtacactgatgattttatttttaaatggactgtgtatgggtgcaagtattttgatggggattcaatatggggcaagggattataaaactttgcaccgccagattagtacaacgatgctttcaggtgttgtattttctgtatttttaacacttatttgtgtcatttttgcggtgccgattttgcggttacttcaggtagacccatcgattctggaaatgacaaaagaatatttgagaattattttctggggactggtatttacttttttatacaactttttttcaagcacccttcgagcactgggagacagcagttctccgttgtattttctgattatcagtgcagttttaaatgtatttggcgatttgttttttgtcgtggtattaaaggctggatgcaatggctgtgcggtttcgacggtattaagtgaagcattgtgctgtttattctgtgtaatttatattcagaaaaaagtgccgattttgcgattgggaaagaaatggctggtgtttgatgcaagtcttttaaagcgaacgattgcttatggatgggcatcggcaatgcagcaggcgacggtacagcttggaaagattgggattcaggcgattgtcaatacgatgggagtttccgttgcggcggcatttgcggtggtaaacagaattgatgattttgcatatacaccggaacaaaatatcgcacatgcgatgacggcactgatggcgcagaacaaaggggcaggaaagaaagaccgtatgcgggaaggattccgttgtggatttatattggaagtgatttatggaattctggttttaattatctgttatgtgtttgcaagaccgcttatgatgctgtttgtaaaagatgaagaggtaatcggtcacggtgtgatttatttacagttgatttcacttatgtatatacttccgggaattacgaatgcacttcagggatttttccgtggaattggagatttgaaagttaccttaatcagcagttttacaaatatgggagtgcgtgtacttgcagccgctccgatggtttttttatggggatttggaattgaagcacttccgtattcttatctggcaggatggattggaatgttacttgtggaagcaccgctgttaattaagatttacaggaagaaataaggcacaagctgaatagaataataaaaaagaaaaataagaaagcagaaatctatgaaattagagcttttgcacatttcaaaacaatatggcaaaaaaacagcagtggaggatatgtctcttgttttgacaaacggcgtgtggagaatttccggaaatcctaaatgtggaaaaacaactctgcttcgtctgattacaggaagcgtgaagccgacagagggaaaactcttttataacgaaagaaatatttttgaagattattcacaatacaaagcagtgcttggttatctgccgcagcattttaaaccggaccatttatttacggtaaaggaatatctgaattatatttcagcttataagggcttatcgaagaaacagacaaaaagaagaactgcagaggcacttggagcacttcgtttgtgggaagtgcgggacaaaaaaatagcgagactttcaagaggaatgagacagagagtcggaatggcacaggcagttttaaataagccgaaggttttagttttagacgaaccttcggcttatttagatgaaagagaagaaaatctgttttatgagctggcaggagaattttttcaaaactgcattgtgattattacagagagaagcagtttggatgagacgagaagcagatgcgaggaagtagcggactggaatctgacgatgaaaaacgggaaagtggggagtatttagaatgaactcaataagtgcgaaattaaaatcggaaataaaacgaacattgtatacaaaatggatttggtttgcaggatttttggcatgtctacttggaaagataacccagatggcaggacaggacagcattacatggaggtgtatttttattgcttcggcaattttaatcagtgaagttttttggctgtttgagctgaaaagcccgaaagatgaggcagtactctgcacgaaatacggaaaccggtggatgcatcaaaaaagagcagtgattctgtgggtgctcgtgttattgattttattaatttccggtttataattttgtcagaataaaacaaagagacattcgatttttttcggatgtctcttttgcatatcaaccgttttacttaatcaatcacttttttgattgcatcaagcagttcgtcataagtttcataagccggaatttccggatattctgctttgattgcttctgtacttttaaataaaaatcctgctttacttgcctgaatcataccaaggtcattatggctgtcaccgcttgcgattgtgtcataaccaatggactgtaatgcttttacagtagtatatttggatttttcacagcgcatcttaaagtctgtgatttctccattttctgcgacaacgagagagttacagaagatggtcggatagccgagttttttcattaaaggtccggcaaactgggagaaggtatcactgataatgataacctgagtcatttctcttaacttgtccaaaaattcctttgcaccgggaatcgggtcaatctttgcgatggtttcctgaatctcttttaatccaaggttgtgttcttttaaaatgtttaagcggtatttcatcagcttatcataatccggctcgtctctggtagtttttttgagttccggaataccggtttcctctgcaaatgcaatccagatttccggtacgagtacgccctctaagtctaagcaaacgatttccattttttcctccattctaaagcaggttgatagggtccattctatcgaaccctgcttttgcttaagtatttatctattcttatcaaaacctattatattagaaaacgaaaaaaaacgccactgaaaattttacgttttaatgcgataaaattttcaatgacgcttagaaatcattttagaatcaaatacaggattcaattaatcttaaaataaatgattgaattgtacttaaatagtggtaggtgattttttatttctcaattggaaaccagccaaagtcaatgcatcttccaaggtcccagctgtcccagccaacccatccaggggtgtttacagtatcggttagcagtttgtagctccagtagaagtatccgcttccggcatcccatgcatctaacatggcttttgcaagtgtgttgtaaatttcttttttcgtttcagcactgatacattcttcgcttaaaccttctacaccatttaatactgtctgtccgcctttggtgtcatgtccaacagcgagagaattgaataagcaccattccccacagataaccgggaagtattcctgcatttctgcaatgtcttttttgagttcttctacataagaaacatagttttctacgttctgttcacagccgttcatctcagcaaccatcaggtactggtgcgtatcaagtacaacgtttttatatttttcttcacgcatgaaatctttccatgcttttaagcggaaggcatcatggaaaacaacgtatttttcttccggcatgtgtttgcggattctgtcgtaagcctccaaataaaaaccgcggataaattccattgtatttggttttgttccctttgctttttcagggtcaactgccggatagcgttctgctacgttcatagattcccacatatcttcaagtataggctcgtttaaaatttcgattccccataagccttttcttgtaccgtatctttttgcaagtctttcaagaacagtgagttcaaattcaacttcgtccggatcctgtgaccatttgcagacaccactgattccgccattatcaaatccgttctggctgtccggtgcagtatgtaagtcgattaaaatctgaagtccatatttttcagcccagttaaatgctttgtcaagttcttcgatacatccgataaagggctctctgtcgccaaagatgaaatacggaacagggattctgactgcatccattcccatcgatttgattcttgtgaaatctctttctgtgatatattcagaacgatggattttgatttttgcctcataaacttctttggaaagttgtgttggaagataatattcatcttcagcagttgttccatcgaataaagatgggctcatccatttttcaagtaccagccagttaccaagattaacaccttttactttcatgtgttctgtttcctttctcttttttaaaaaattttttatttaaaaatgtgattcattgttttttgcaatcgttattttacccatccaaatcttaaatttatatcataattattggaaatttatcacttatattgtgaaaaaatctgtgctataatggaaaagcaaaagaaaatgcaaaaagaaatgcaggaagaagggagcgtgaaaatttgaatatagattatcttgcatggcatgtttcacatgaacttcatacatttgtaagacgctggagcggtgaattaaaaccggataataagccggaaattttttgtgccagaaaggatttaaaagacgattatttttctttttcagagtttgaagattatatgaatcaatgtctggctggaaaatttgtgtctgcgtgtccggtagttttttcggcaggtttaaaagagaatcaagtcgcttatgcctatcttcaggcaggagatttttactatttagtcggaccggtacggtttgattcaaaggttcgtctgtattatcatattggagaatttgaaatcccaaagagcgattttaatgcggtatttagttctgagttttattttttctgttctaatattttactgatgtgtaatctgtttcgcaaggaaattttgacaagggatgatattgtctatgaaaactgtgaagaacagattcgagattcggaaattatggaagaatactcggcacttatctttgaaaggcaggaacttgaagaaccacacaatccttatgaacaggaaattcgagaacttaccagtattgaactgggtgacatcgagatgttgaaaaaaagtattggagaagattatcttggaaagaccggcgtgctttctaaagatgaactgcgcaatacaaaaaatcttggaattgtggttatgacgcttgcgagcagggcggcaattcgaggcggattaatgccggaaatctcgtattccatgagtgatgtctttatccagaaaatcgaagaaatgacagatattgtggcgatttatacggcaatccgtcagtttgaaatggaatatgcaaagctggtggcagaaatccgtaagcaggatgagaaaaaatccaaagaaaagcagagtatctgggtggaagccagcaaagagtatatctttaaacatctgcatgaaaagattcgggtgcaggaaattgcagattacctgcacttaaattccagctatttatctgaactgtttaaacaacaggaatctatgacactgactgattttattttacaggagaaagtaaaactgacgaagaatctgctgacgtattcgccgtattcttacatagagattgcaacttatctgggattttcttcgcagagtcatctgggaaaagtctttaagaaatatacggatatgacccttaggcagtatcgggaacggtatggaagagaacagatacaggaacgaagaaaggcagaattaatatcaaatgaatgaggttgaggagttaaccgaatcaaaaagaaaacagcgaagcggaggaaaaatatccgcttgatacaaaaaagaaagaggaaattaaaaaatgggaaatgacttatttgaaaaagcaccgattccgaaagcttatttcagttttgcgcttccggtggtatttagcatggtgatttcgctggtttataatatggcggacacctattttattgccgctaccggaaatacgaatctggttgcgggtgtttcacttggcgcaccgatttttacgttaatgattgcgcttggtgatatttttggactgggcggaagttcggtgatttcacgactattcggcaaaaaaatggatgaggacggaaagcgtttaagtgtgttctgtttttatggagcaattgtatgcggaattgttgtagcagtgttgatgatgttgttccgtgcaccgattttaactctattaggtgcaaaagcggataccgtgcagtatgcatcggattattatacttggctggtaatcggtgctccgtttattattttatcttttacgccgtctaatctgcttcgaacggaaggattttcagtagcatctatgacaggaacggtgcttggctctgtgattaacattatcttagacccgatttttatcttcgtgcttggcatgggagcagccggtgcagcgatagccacggtaatcggaaacatcggtgcggatttattttttgtatttttcttactgacaaaaagcaaacgtttgtccatcaatccaaaaggattttttatcagcaaaagagaacttggagatatctttgccatcggaataccggcatctgttaccaactttatgcagagtcttggaattgcgctgaccaatcgttttttactggtctatggaacagacaaagtggcttcgatgggaatcgtaatgaaaatcaatatgattgcaatgctgattttagttggctttgcttttggttcacagccgttaatcggatataattatggtgctggaaataaaaagcgtctgaaagcgattctggcatttagttataaatttgaatgtgcaatgggagctgtgctagcacttattttatgtgtttttgcaaagcctttgatttcgatgtttatgaatcaggaaagcatcgtaaatgcaggagttccgatgctcagacttcagcttgcaggtgcagtatttactgcggttacgctcgtaagtacctgtacgttccagtccgccggaaaagcattaaatgcttttcttttatctgtcagcagacagggcgttatctttgcagttgtgatttttattttgtctaaaacagtgggctattatggagtactttcggcacagccggtgtcagattttcttacagctgtgcttgccgtgattctggtgagaaggagcgtataccgagagatacgataaaaaattagaaaataccgttattgtggtttacaaattgtcaaataaaaggtaatatacttttataaaatattttataaaaggaagcttttgtatggcgggaatagagaaaaaaaatgttacaaaatctaaaattgtgaactacattatcaatcataaggcaacgtctaaggtagagttatctaaagatttaaatatcagtatgccgacagtattgtctaatgtaaaagaattgctagcaggtggaattgtgattgaaacaggagaatacgaatcaacaggtgggcgaaaagcgaaaaagattagtattaatcctgcatatcgttatgcggttggaatcagaatcactgcaaagcatatagggtttgtgcttgtaaacatgaagtatgaaattgaaaaatatgaaagaatacgactggaattttcaacaaatacttcttattattcaaaaatcagggaagaattggaggcatttcttaaggatgtagaaaacagggagaggattctgggaatcggtatttcgattcctggaattgttaacttggagaatcgaatgttggtgaaatctcatgctcttcaattagaaaattatagcttgaattttctggaacaggtgttttcactgccggtatactttgagaatgatgcaaatgcagcgatgagagcagaagatttaaatagatataaaaatgcgttgtatttatctttaaataatactttgggtggtgcgttttgtattgatggaaaattaatcttgggagaaaatcagaaggcgggtgagtttgggcatatcattcttgttccaggcggaaagcaatgttattgtggaaagcgtggatgtgcagatgtttactgtgcggcgagcgcactgacggatgataccagccaaacattagaacagtttatgcagcagttagaagaacgaaaggaaagtgcacagcaggtttggcaggaatatttggaatatttagcggttttaatttcaaatttgcggatggcttatgacatggacatcattcttggaggcgaagtgggtggatatctttcagattatatgattccattggaagaaaaagtgatgaaatataatgggtttgaccatgatgcaagatatttgaagatatgttcttataaaagagaagcttctgcagtaggtgtggcaaagtattttttgcaggagtttataaaagatatttagttgcttgtaaaagagaaaaagttccagagagaaagcagtttaaagaatgttttctctctggaactttttttgctttctggaaaaatgcataaattcacagaaacaatcttgtgcaataggcagaattaaacgttgggatattgacaaattttatcttttggataataatgtaattactttaataaaatgtttaataaaagaatataaataaaggaggaaatacattatgttacagcaggtaatgacaaatccaggagaaattattttcagagaggtaccagttccagaggtgaaagacaatcaggtgttggttaaaattatgaatattggaatttgtggttctgatattcatgtataccatggaaaacatccatttacaaaatatccggttacacagggacatgaagtgtctggtgaaattgcaaagattggaaaagatgttacagagtttcgtgaaggacaaaaagtaacaattgagcctcaggtatattgtggagaatgttatccatgtcgtcatggaaaatataatctttgtgaagaactcaaagttatgggatttcagacaacaggaacagcttctgaatattttgcagtagatgcgtcgaaagtaacaccgattccagaggagatgtcttatgaagaaggtgcaatgattgaacctcttgctgtagcagtgcacgctgtaaaacagatgggcgatgtgaaaggaatgaatattgcagtgcttggagcaggtccaattggtaatctggttgctcagtcagcaaaaggaatgggagcagcaaaggttatgattacagatgtcagtgaccttcggttagagaaagcaaaagaatgtggaattgatgtatgtgtcaatacaaaagaaaaagattttggtgaggcaatgattgacgcctttggtccggataaagcagatgtaatttatgactgcgcaggaaataatatcacaatgggtcaggcaatcaaatatgcaagaaaaggaagtgtaattgttcttgtggctgtatttgcaggcatggcaacaattgaccttgcagttgccaacgaccatgaactggatattaagagtacaatgatgtaccgccatgatgattatgtagatgggattgcactcgtaaatgaaggaaaggtacatttaagaccattaatttctaagacttttgcttttaaagattatttgaaagcatatcagtatattgatgataatcgtgaaacaacaatgaaagtaattattaatgtgcaggaaaaatagaacgataaattttggaaggatggggtttagtcagaaacgctgataaggaggaagttatgggaagtgagagtaagaatggaaaagtgccgttgattagtaaaatcgcctatggatttggagatgtaggctgtaattttagctggatgtttgtcagtaactttctaatgattttttataccgatgtgtttggaatcagtatggcagcggtatcagccttgatgcttttttcaagattctgggatgcaatcaatgacccgattgtaggaggactgacagataaaacaaatacaagatgggggaggtatcgcccatggcttctgattgcggctccaattacggcggtgcttttgatgctctccttctgggcacatccagactggtcgaatacagcaaaaatcgtttatatggtaattacatattgccttctggtattaggctatacttgtgtaaatattccgtacggaacactttgtggagctatgacacaggatattgatgaacgtgcaaaaattaatacttcccgttccgtgtcagcgatgattgcaatcggaattattaatattgtgacagtgcctttgattagtaagctaggaagcagtagtgccaaaaaaggctatctgcttgttgcgattatttatggatgtatctttgcagcctgtcatttcttctgctttgcaaagacaaaagaacaggtaacaatccctgaaaaagagaaaatttcaattaaagtacagctgaaagcagttatgcagaataaaccatatctgcttgcactggttggacaggtattgtttggatttacattgtatggaagaaatgctgatattttgtattattttacttatgttgagggaaatgcttcttactataccacctattcaatgtgcattattattccttctattattggtgcagcatgcttccagccagtattccgtaagttaaataataaaggaagaacagcttctatttttgcattacttacaggtatcgcaatgcttgctatgtatttctttaatgtaaaagaatcaccaatcacattttatgcattagccggtattacacaatttttcttttcaggatttaatactgcaatttatgccattattccagactgcgtggaatatggtgagtggaaaacaggacttagaaatgatggattccagtatgcctttgtttctcttggaaataaagttgggatggcagtaggtactgcgtttcttgcagcattacttggaaaatatggatatgtggcaaatcagacacagaatccggaagtaattgcaattatgaaacatgcattttcaacgatacctggaattttgtggattgttacagcaattgttctgtttttctatcgtctgaataaaaaacgctataatgaaattgtggaggacttgaaaaatggcaaaagaggttgatattgtcgctttaggagaacttttgattgattttacagaggcaggaaaaagtgattcaggaaaaaagctgtttgagcaaaatcctggtggcgcaccggcaaatcttttaactctagcctcacgtatggggtatcgcacggaatttatcggtaaagtcggaacggatatgcatgggaattttctgaaaaaaactttggaggaagaaggaatcggaacaaaatatctgatttaggatgaaagatattttacaactcttgcttttgtagagattgcggaaagtggggagcgtcagttttctttttccagaaaacaaagtgcagacacacagctttgtgcagatgagttaaatcagaaattgcttgaagattgtaaggtatttcattttggttcgttgtcattgacagatgaaccggcaagaacagcaacaatagaagctgtaaaaatagcaaaatcatcaggtgcacttatttcttatgaccctaattatcgggcatcattatgggaaaagaaagaaactgctgtagaacagatgaaatccatgataccttatgttgatgtgatgaaagtgtcagatgaagaactagttttgctgacaggaaataaagattatagtcaggcagttaaaatacttcttgatataggaccaaagttagtggctgtgacgtttggaagcgaaggggttcttcttgcaacaaaacagagacaggagaaactaccaggatttaaagtgaaagcgattgatatgacgggggctggagattctttctggggaggcttttaaagtgagtatctaaaacaaaataaaaaaattgaagagcttacatgggaagaacttaaaaagtgtgcaaagtatggcaatgcaacggcggcattgtgtgtgcagagaagaggtggaattccggcaattcctaaaaaagaagaagtagaaagtttgtgtaagtaaatgatgcaaaggggaatgtgaaaaaaatggattttcacgttccctttgatgttttatcgagagatacgataaaaaattatatttaaaaatccaaaaaaatcagttattttatttccaagtaaagataaaatgtacttttgaaatgtactttcaaaacattccaaaagtaaaaaagtacattgaaatatacaggaggaaataaagttatgattcataatccaattttaccaggattccacgcagacccatgtatctgtcgtaaaggggatgacttttacgttgccgtttcttcttttgagtggtttccagggattccgatttatcattcaaaagatatgaaaaactgggaattatattctcatgcgctgacaaatgccgatgactctgatttgaaaaaactgccaagtgcaaagggaatctgggctccgcatctgaccaaacatggtgattattattacattatgtgtgccgaaggtgatacaggatattatcacagtgtgacaatgggtcgttctaaaaacgtatacggaccttatgaggcagacccatgcaatccgattttaacttctgcaccaggaaattataacgaacgtgcagattgggatcatttaaaaccacgttactacaatccagagagcaaacttcagaaatccggtcatgcaagttatgtggatttgccaaatggagaaacctggatggtgcatctgacttccagaccatttgtaccggaacttcgttgtacacttggtcgtgaaactgcaatccagcgcatgaaatagaaataaaaagttccagtttagtttttttaagaactattctggaacttttttgtgcatatcaggaagggttcgtacgaagttgtatattggagataacctccgatgcacactaaaattattaataattggaaaaatacaccgtaatcgtacagatttcgctgtctgttccaacccgcattgccggaccccagacaccgactccggaagttacaatgctgttcagattacctttttttaagtaaccgcagggattttcccagaataattttaccgttagatttccgggaaaaatctgtccatcgtgagtgtgaccgcataactgcatatctacgccggcattatcaagttcttcaagttgttttggctgatgttccaggacaaaaacaggtttggttttatctacgttcgagagcagttcttcgatagtttttcggttcgttgtgccgtctcctggtttttgaatatcttttcggccaacgagataaaaggcattgtcaatacaggtgacttcatcatcgagaagagtgatatcggcatcttttagaaaactttcaaatctcgggtcacggacttcgttttcttttgatgtaactgaaaatccacctaagagccgttctgtcacatcatggtttccgaacacagcataagagccataagtactttgaatcgtagaaagtgttttggcaattttatctggattttgaacggcttcatattcgttgtcaaaaacgtcgcccgcaaatacaacaaggtctgcattttgtgcattgattttctttaccatgcgctgcatctgcctgtcatcgacactgtaaccaagatgcaaatctgcagcgagaacgatttttaaagaatcatgtccggcgcaggatttttctacagtaatatcataaggcgtcacttttacgtgtttggaatgtaaaattccataagcgctgataccgcagataagtgcggtaagcagaagtccaacaaatacatagccggctttacaaaagaaaaactcatgtatttttccagtaatttgttttaaaatcagccggagaatatctgcgactgcaataaacattaataaatataaaaatgtgccaagccagtagttgctgattcgctttacaagtacctgaaattcagaggcaggcagtaaaaatgcaaaaagcagagaaagcgccagcaaagaataaatagtaagataaggcacaacaaaccatttggaatgaaaacgctcagaacatgcagtcagccatttatggattcggtgcaggatgtaggcgtttaataaaatataaatgggaatgatgaatattaaaatcataatagggcttcctttttgtttttcagaatagcacaaatggcaggaagaagcaaatgaagggtgggcatttgatttttgataagaaaagacatataataagtatagctaagaaatgcgattatactctaagtgagtaaaaagaagttcggagtgccagctctgaacttctttttttctgattttttatgctaatccctcaattgcttcttctatgatatcagcaagtttttctgttgtaatttccataaacagtgactgcatcggtccaaatgaatcaataatttccattagttttttgcggtcatgaggattttcttttaattctttatactgaccagcaccatagatgatgcggactggcccttcataaataaaatctttcatgagctacctccaaaataaaatgttatattagtgtgtccgtatagtagaaatattaatatactagggtaacccgagggcaagaaaaattttatcatatctaaagtttacaatgtagaataaaaaggctaaaggtggaagttagttttttatttgaattttcacagaatgttcacaaaaaattagcactcacctcttgacagtgctaataatacgtgctatagtacaattagaacaaaggaagagggaaatagagagagacaaagaaataaaaaagcctttcccctctggtttgacctaagttccaaaaaagaaacaggtaaacagcaattaagattttgagataaaaaaggagagatgacttatgttgatgcctagtatttttggagaaaatttatttgatgacttttgggaattcccattttttgataacagtaaagaacagaaaaacattgaaaagaaactgtatggacatcatagtaaaaatatgatgaaaacagatatcaaagaaactgaaaaaggttacaccattgaaatggatctgccaggatttaagaaagatgaagtcaaagtagcacttgaaaatggttatctgaccatagcagcagcaaaaggacttgataaaaacgagaaagaaaaagaaaccggtcgttacatcagacgtgaacgttattcaggtgcttgtgaacgtagcttttatgtaggagcagatgtaaaacaggaagacatcaaagctcactttgaacatggtatgttaactctgtttgtacctaaaaaagaagcaaaaccggcagtagaaacagataaatatatttccattgaaggataagtagattcctctttaaacaaaattaaaataaattaaaaaaccgccctgtgcacttcgttggagttgagatgcacagggcggttttgatgtaaagcggatattcgtaatccaatttgttacctgattaattcagtcaaataaattttctcttgtaatattctgtgcccatttaccctgacggtaatgatgcagtacccaaggccatttcacaaattcatctgtacataataagaaataaacccagagaaccggaagtttcaggacaaaggcagcgaagaatccaagtggaactgcgtagacccacatatcaatggtatcacagattaatccaaatttggtatcaccaccggctcggaatactccggcaatgagtgcggtatttacagccgaacccataatataataagtgttaattaagagcatatattttaagtagtgcattgcctgatcatttagagaggcaaatctcattacaaaaggtgtgattgtcagtacgatgacaccaccgattgctccggcaatcacagtcatttttaacattctggatgcataaactttagatttttccaagtcaccttttcccataacattgccaagcagaatggttcctgcactggcaatcgcaaaacagaacacggaaccaatgttacggactactgtaaccagagaattagcagctacagcatcggtacctaaatgtccaagaataacagaatacatggaaaaggctacactccatgagacatcgtttccaagtgccggaagtgataatttaataaagtcgtttaataaaactttactatggataaacatataagccggatttagttttacgtttttactcagaaaagaaacaatgatgcaggcaattagttcgattagtcgagaaaaagcagttgcaatggcaacaccggctgctccgagttttggaagtccaaataaaccaaaaataaagaccgcatttaaaataacatttaaaacaaaagcaagcatatttaatgccatactgatggttacccgtccgatacttcgcagaattgcaagataaacttcggtcacgccccagcataaataagtaattcccatgattcttaaataagaagagccgatggatattaactctgggtcagaggtaaagattagcatcatgcggtttggcatcgtaaatgcaatcagggcaacgacaccggaaattgcgattgaaaaacgaagggcaattccttcgattgcgtgaatcgcctgtaaattattttgtccaaagtattgtgcacataaaagcgatgcacctgtgccaagtccataatataccataaacaggatattagaataactggcagctaaagaaactgcggaaattgcggattgtccgacataattgagcatgattacgtcggcggaattgacggctgcacttaacagattttggatgataatcggaagtgtcagccgaaacatttgccggtaaaagtcatctttaccggttgaaactatatttttcataaaaatcccccataaattattataaaatttattataatgtatttgagagaaaatttcgtcctttattctgacggatttctacgttattttgactgtgatgtttcttctgtctgcagggttcacagaattttcacaaaaaattagcactcatctcttgacagtgctaataatacgtgctatagtacaactagaacaaaggaagagggaaatagagagagacaaagaaataaaaaagtctttcccctctggtttgacccaagttccaaaaaaagaaacaggtaaacagcaattaagattttgagataaaaaaggagagatgacttatgttgatgcctagtatttttggagaaaatttatttgatgacttttgggaattcccattttttgataacagtaaagaacagaaaaacattgaaaagaaactgtatggacatcatagcaaaaatatgatgaaaacagatatcaaagaaactgaaaaaggttataccattgaaatggatctgccaggatttaagaaagatgaagtcaaagtagcacttgaaaatggttatctgaccatagcagcagcaaaaggacttgataaagacgagaaagaaaaagaaaccggtcgttacatcagacgtgaacgttattcaggcgcctgtgaacgtagtttttatgtgggagaagatgtgaaacaggaagacatcaaagctcactttgaacatggtatgctgaccctgttcgtaccaaagaaagaagcaaaaccggcagtggaaacagataaatacatttccattgaaggataaaaacattccttttagataaagacagataagtaaaacgccctgtgtattttttaaaaaaagagatgcacagggcgtttttttgcacttactcaaaataagttgacatttaaatttaaaatatttataattctaattgtttgaattataaatattttggctaaaagaggaggggaatttatggatgattcattacactatctgattatggcaaatcagatgcttgttcagcgtggtctgttagagcggttaaaggaaaccggacttacaattggtcagccaaaggtgctggattatttaaaggagcatgatggaagtaatcagaaagaaattgccagggcgtgttttttggaggcgggttctttgacttcaattttaaaccgcatggaagaaaaaggactggttgagaggcgcatgttaaatggaaatcggcgcagttttcatgtatttctgacagaaaacggaaaaaaaaatcaggaactggtggaagaaatgtttgcggagattgagaaagatgcactggatggaatttcatcagaagaatttgaaactttcatggaagtatatcggaagatttatggaaatcttttacaggcagaacgaaagacagagaaagaaggaaaaatgaaaaatgaataaattaaaacgatatcttttatttttagtaggattatttgtaaatgcactgggagtcagtcttgtcacaaaagcaaatctgggaacttccccgatttcatcgattccttatgtattaagtttgaatttcccatttactttgggtaactttacaattttttttagtatttttttgattgtgttgcagattttaattttaagaaaaaactttaaactggaaaatattttgcagataccggtatccattgcatttggatattttattgacttgacgatgtatctgtttttctgggtagacccacagaattatctgttgaaaattgtggcactgttgattggatgtggagtgttaggatttggtgtttatttagaagtggtcgcagatgtggtgatgcttccaggagaatcctttgtccgtgcaattgtgcagacctggaacacaaattttggaacaacaaagattatctttgatacttccatggcggtgattgcagcagcgttatcttttgtgtttgccggaaaattaaacggagtcagagaaggtacaattattgcggcacttttagttggatttattgcaagactgcttggaaagaaacttgagtttattaagttattcttattcccggaggaatatagaaaccaagaagaaattgaagaagcagatgagacagaagcagagcagaagtcaaagaacgtaattgtgatcggcagatagtatggaagtggtggacacgaaaatgaattacatagaagagtgtataaaaaaagcaatgtaaattaaagcagaaaagcagtaattttatccggaagtcttggtataatcaacttatgaaattttgtatgaaaaataaagatgtactttcggaatcatatcaaagctttcaagagtacatgaaaaagattgggaggaatcagtatgccaaaacgcttctgtaataaaagaaaaaaacagcttcggaattaagtttccggagctgttttttctataaaatcaagatatttaagacattcatccttatgtggagcatttttgataattccaacatagatatccccatcaaattttgcattttttaaaagtggaaaatccgagacattgatactgtcagagagatatccttttttatttaattgttccattgcttctcgattcataaatacgaggtctattttttttgcgtcaattgcagcaagaagtctggtgcttgatgcataagcgtattctaagttttccgagtctggattctcctgtatcagtaaattgtcataagtacagatttcatttttctttgcagataaatgttcaaagtctaaaaaatcactggtcagatgctgagagagagattcgctcatattaacattaataaatgcaatcgagagaacagttgttttttttacaagctgtccgtggatattataaacaagaatataaagtacgatgcaaataataataaaaggcagtttgtaataatcccaaagatattgaagttttgcttttccgtgaagttgttttaatgctttcatagaacatcatccttattattttcaagtcgttccagaatcggaagaatcagccaggagcagataagtgctccgagtccttgtccaaaaacaataaatggtgtgaaaatattgattataacatagtaaataacaaaataaacaactgccatcaaaatagaacagaacagataacgcagtcccatgacaagtgcatttttaaaagttgcaggaattgtattttcaaatcgtgcaaataatggaaaaacattcagtaaaacgataaggtatacaactccggcacagatgagcactgcaccgcataaagtccagaatacattttccagacgaatatgataaagcacatagccgtcaattccaaataggatgccaagccccaaaagagggagccagatcagtgtggcttttttgaaattagaacgaaatgcagtaaagaactgctttgtaatattgccttcttcattgcgtacgagtttgaatgaaacataataaagggcagttgtcgaggcaccgattgtaaaaacaggaatacaacataaaaaccaaagggtattgagccatgcagcacaaaaaattttgtttaaaagctggatgaaacgattatcaattgaaaaaatctgattcataatattctcctttacttggttggagcaatgtttacggattctcggtatacaatgtttgtttcggtataaacggttcgataatttaaagtcggatcttttattctggagagcaataaatctattgcacaaactccaagaatttcattgtgaatgtggatactggtaagcggtggagtgataagtttagcagcaggagaatcgtcaaagccacatagacaaatatcctccggaacttgaatatttaattgtcttaatatttgcatcagatcaaaagcaataaaatcatttgcacagacaaaaacatcaggaagttcttttaaattttgaatatagttaaaaagataagttttataatctgtgagtgtgtcttttggagcgtctataataaaaaactcttcattaattggaagcgaatttatatagagtgcattacgagtagccatgcagcgttcaaaaaaagattggcaatgcaactgctcgccgataaatccgatatttgttttgccacattttttcatttcacgaacgaaggcaaaaatttcatcctggttattcataagtaaacgatcagcaggaagaggttttcccataagtaccggatggtctacaaataaaaccggaatatccagattgcaaatcatttttgcgtagtcatagttaaaagtttcaatacagataatgccacagacattctcaggatgaaacgaattgggaagctggtagttggcttgttcttcattgcttacgcggtgcatcgtaatgatatagccaagttgagtggtttctctttgaatcttatctaacattgtagaagaaaaatgaaaattatcgagcggagcgcaggttaggattgcaatttcaccatgaggcttttgtggagttgcttcttgtgaggaaaacttaagttgttctgggttcatataggtaaattgtttatagcccatttctaccgttttttgtaacactttttctctggttgaatcagataagactcctgtgttgttgatggcttttgagacggtatttcttgatagtccaagagcatcagcgatatcttgtatcgtcacacgttttgacataataaaatctccttttcagttctaaaacaataattggactgttacaaatgtaaaataattatatgagtttattatagaataaatttgcgaatgtgtcaaatgtaaaataaatagtaaaaataaacaaaaaaacaaggaaaaatgagggaaaaacagcatatagcatcgtgaaattcttacaaaagtgtgcgtatgtaacaataaatagttgacatttgagtataaaattgatattatgatgacataagcaaaacatgttatgtttacaaatgcacacattctgtagaaggaggaaagaaaatggaacagaaaaagaaatctggattcggtaatacggttgcatatgtgaaacgtcattggcagttgtatgtattctttttattaccggcattgttgctcactttgatttttaagtatattcctatgggcggcgttttaattgcatttatggattataacccggttcgagggattcttggaagtgattgggttggactggaacatttcagaagatttttatcatcaccggactttatgagatatttagtaaacacattgaagcttagtgtgtatggcttattgtggggctttccggtgccgattttacttgcatttttgttaaatcgaattgttagtaaaagaaagaagaaaaatattcagctcgtgctgtatcttccgaactttatttctgtcattgtattatgtggtattgtacgaatcttcttgtctgtaacaggaccggtaaacggattgtttggaacaagtatcaactttatgacaatgccgtctgcttttcgtacgatttacattgccagtggaatttggcagggggcaggctgggcttcgattctgtatacagcagcactatcaaatgcaagtcaggagttaaaagaagcggcagtaattgatggagcaaatattttccaacagattaaagcggtggaatggccagccatcaaagatattgtattaattcagttaatcatgcaagttggaaacattttaagtattggttttgaaaaagcctatgcacttcaaaccgatttaaaccttcctacatctgagattatttcgacatacgtatataagaaaggtttgattgatggagattatggattttcaaccgcagttggcttatttaatacggtaatcaatgtcatcttattaattgcagtaaataaaatcgttaaaaaaatgaacgatggaaagggaatttaggaggtgtgagtatgaaggcgaagagaaaaagtcaattttccaaatatggccgacaagataaaattattttatcgattggatattttttaattgcattgtttgtacttgcaattattgtgccaattttttacatcatagttgcatcttttatggatccggtaacattacagaataaaggaattacatttgatttttcaaaatggacgataacagcgtatcaaagggttatgtcaaatggagcaatctggattggttttaaaaacgcagttatttattccgttgtatttacagtagtatctgttgtggttacattacttgccgcatatccaatgtcacgtacggatttcaaggggagaaaattatttaatgttatttttgtaatcacaatgttttttggcggaggtttaattccgacatacttattgatttcaaatcttggtttattagacagtatgtgggcggttatccttccgggtgcatttagtgtatggaacatgattattgcaagaacgtattatcagggaattccgggagagttaagagaagcggcagaagtagatggggcaaatgagttggtattcttctttaaaatactgcttccggtttgcacaccgatcattgcgacaatcgcattgtggcagtttgttggtatgtggaacagttactttgatgcaatgatttatttaaatgattctgcgaaacagccgttacagttagttttgcggtccattttgattcagaaccagccggaatccggcatgatttctgatatgcaaagtaccgcacagagggcacagcttgcagagttattaaaatatgcaacaattattatatcgagtctgcctcttttagtaatgtatccatttttccagaagtatttcgatagtggaatcatggcaggttcagtaaaaggttgatgtaggagggtaaagatgaaaaaaagaacgaaaaaagtatggaaaagaacagcagctatggcattagcagtggcaatggcagcaacgacagttactggatgtggaagtggtaaatccagtgcaaaattaaatgatggaagctttaaagaagtggatgcgtctactctggaatttccgttaaaagagaaagcaactttaaccggaacaattagttatccggcaaatacagaatctgaaccgaataagagaacgatttttaaaagacttcaggaaaagacgaatgtagaaattgactggacggcgattcaggcagatcagtggagtgataaaatttctctggaaatggcaaatacaaaaaatatgacagattttatcttttcagcgggattcagcgataatgacttgttaaaatatgccaaacaaggtgtaatcattccgttggaagaatatattgacgcatatatgccgaatttacaggcagtttttgaaaaatatccggaatatcgaaccatgtgtactgatacagatggacacatctgggcacttccatggattgaacagcttggaaatgaaaagacagcaattcagacaatcggaaatatgagttttattaataaaaaatggctggatttcttaaatcttaaagttccgacaaccgtagatgaatttgaacaggtattaattgcgttccgcgatcatgcatctgaaattcaggcagagtttggaattgatggaagcattattccgatgtcttgcattgtaaatgatggagaccaggatccgagtttaattatcaatggctttggagaagggtatggagatgcagataaaacaagacatattgcagtgacaaatgataaagaagtcatctgttctgcaacacaggatggatacaaagaaggtattgaatggctgcacaaattgtatgaagaaggcttaattgatacagaaagttttacacaggaatggtctacttatgtagcaaaaggaaaatccggacgttatggtgtttgctttagctgggatgtggcaaatattgataacttagaagactgggttccgcttccggcattaacagcagatacaagaaatattactcctcagaatggttctttcacaagtggatttgacagaggaagatgtgttgtaacagcagtagcagaaaatccggcacttgtttgtgcatggttagaccagatgtatgacccattccagtctccacagaataactggggaacttatggtgaagacgatgactttgatatctttgaactcagcaagaatgcagagggtggagaaatgctcaagcatgcaccgcttggagatgcttcaccggtagaagttcgtgaagcagaatcagttggaggtccgcttgcagtattaaatgattactatgatgtttatgtgacctgcccggatgatgcacaatatcgtttagactggattaaagaatattatacaccggatatgaacctggattatgtatatccaaatgtatttatgaatcaggaagatacaaagaaattgtctgaccttcagactgatattgaaaaattaatcaatgcaaacaaatccgattggattatgaatggatttacagatgatgactggaaccagtacttaagtgaattagacggatatggtctggaagaatatctgcagattttccagaaatatctggatgactattatgcagatagtgccaaataaagagaaaagataaggcgagaggctgcgtaacaaaactgcgcagtctcttttttgaaattttttttggaggaaaaggaatgattaacgataaattaaaaaaggcgagagaatatgaagtacggaaagaaaaagaaattgctccagataaaagaccggcgtttcacctgactccaagagtcggctggatgaatgacccgaatggattttcttatcataatggagagtatcatttgttttatcagtatcatccgtatggtacaaactggggaccaatgcactggggacatgcagtaagtaaagatttattaaaatgggaatattgtccgacagcacttgcaccagatgaaagttatgataattttggatgtttttcgggaagtgcggatactttggatgacggaaggcagattcttatgtatacaggtgttcaaagcacaaaagatgaagatggaaaagagattgtgtttcagactcaatgtattgcagttggagatggaacaaattttgaaaaatatgaaaaaaatccagtaattactgcagatgctttaccggaaggcgcaagtaaaattgatttccgtgacccgaaaatctggaaagaaaaagatggaacatttcgctgtgtagttggaagcagaccggcagatggaagtggacagatcttattatatagcagcaaagatggattttcctggaactttgaacagattttgattcaaaacaaaaatcgttttggaaaaatgtgggagtgcccggatttctttgaagtggatggaaaatggctgttgatggtcagccctcaggatatgatgccggtaggcctggaatatggagcaggaaatggaacattatgcgtagcaggtcatttggacgaaaacaaacatttggtagaagaatatacacagtcgattgattatggaattgatttttatgcaccgcagactgttttagcaccggatggaagacgtattatgattggctggatgcagaactgggatacctgtggagtacgggaagatgacatgaaatggtttggtcagacaagctgtccgagagaaattcagtttgtagatggaaaactgattcagaatccaattcgtgaattgagcaattatcataagaataccgtttcttattcagaagtgcttatatctgactgtatttctttagaaaaagtcagcggaagaatgattgacctggaagtagaaattaaaccggaagatgaagaaaattgttatgataaatttgtaatccaatttgccaaaaacgagagcttccattcggatattgtattttatccaaaggaatctgttctggaaattgaccgtagctggtcaggtatcagaagagccgtacagcatcagaaaaaatgtaaagtggcagataataacggaagtataaaattacgagtgattcttgacagatacagcgtagaagtttttgtaaatgatggagaacaggcaatgtcaatggcagtatttacagaacaatgtgcagatgaaatttgcttttatgcagagggaaaagtgaaagctaatgtgacaaaaagtgatttggaattttaaaaaagagttgattttagaaaaattttaatctaagaaagctgggctaagaaaatgacagatgtaaccgcattgggagaattattaattgatttcacagaaaatggaatcagtgagcagggaaatccaattttagaagccaatccaggaggcgcaccatgtaatgtgctggcaatgcttaccaaacttgggaaccagacattatttatcggaaaagttggaaatgacagtctgggaaagatgctaaaagataaggtaacagcactgggaatagatacaacttatctgtatcaggatgagatagtgcatacgacacttgcttttgtacatactgcagaagatggagacagagaattttcattctatcgaaatccaggcgcagatatgatgcttcgtgcagaagaagtgaatgaagaagcaataaaagaatcaaaaatttttcactttggaacgctttcgatgactcatgaaggagtacgcacagcaaccaaaaaggcagtggaaacagcaaaacaaaatcaggttttaatttcctttgacccgaatttaagagagccattgtgggatagtttagatgaggcaaggaaacaggtttcttatggaatgagtatgtgcgatatcctgaaaatttcggataatgaaattgaatggtataccggagaaagcgactatacaaaagcagttgagaaaatcttggaaaactatcagattccgctgattctggtttccatgggaaaacagggaagccgtgcatattataaaaatcagatggtagaagtaccggcgattcttcagaaaaatacaatcgagacaacgggtgcgggggatacctttgatgcctgtgtattagactatattttaaaacatggactggaaaatttgtctgaacaaagtttaaaggaaatgcttacttttgcaaacgcagcagcgtcgattgtcacaaccagaaaaggggcactttgcgtgatgccatcaaaagaagacgtagaagaaattttgaaaaaataagaaatgagccagcaggagtttgaaaacgtgttgagcagagattaatcgaaaaattttgacaggtgaagtctgaaaaaaaacaggagaacaataatgccaacgccacataaggatgttttggtttaatgcctatacggtgcaactcagaaatgggttgcaccgtttttcttattatgcgataaaacgaaaccgctgaggatttttttgcatttcttccatcattgcaagaatttcttgttcagtcggaatatcaatcattccaacagcagtgaaatacacatcaacttttacataacagtgaccgctggatttatcgttattatgaacttcaattcgttcaataagtgtatttacaagcgtgggtgtaagttccttaatttctgtaatttcacggagagtatgtagcaataacctgaggtcggtaactttctgtcctacatcatctaatgccgctttccattcttctatttctgtctgtaaccgtttttgctcacactcataattttgaagcaatttggaaaagcgttcatccgaaaggattccggcagcgttttgctcaaatactttctcaattaacttgtcaatttccgatattctctttccaccacgctcaattgataatctgagttttttattctccgtttgtcgtacaagatttgttttcttggcaagcatatacaaaaatgcggactcgtagcactttacaaaatctgccaagctccttatagattcaagtacaatctgttctaacgatatatctctgatatagtgaatttggcattcacctctgccgcttttgtaatttgagcatcgccaaaattcttgatttcgtttaagacttttcgctgcataaaagtgtaatttagctccgcaatcaggacaatataccaaacctgaaaacaagctttgtcttcctgttgctgtaggtcggtggcgatgttttctcaattcctgtaccctaagccactgttcttcagatataatcggctcttgcatattgggaataatttgatattcttcagtaggattatgaattaccttatgaaccttatagctgacagtcgtgctttgaagtttaccgcacaaccggtgtattgcctgttttcaagaatatttacaacagttttctgatcccatttgcaagaatcgcaaggcactttctgtgtgttttttttccgatactttcataatatgccgatggaataagtatattttccttttctaactgctttgcaatttgtagcggtcctcgacctgcaagacataaagaatagattttgcgtacaatattggcagcgggttcatcaattatccattgttctttgttatctgggcttttcatatatccgaacggaactgttgtagaaacacgcttaccatgctccgctttggattgccatacagcacggattttcttagaggtttgtgcagcataccattcattaaaaatattgtaaaacggaagcatttccataccgtcaccggttgtgctgtttacattttcctgaatggaaataaatgtgatacctaaggaaggatatacaatttgtgtgagtcttccggcttcaacctgttctcttccgaaacaggaaaggtctttaacaataatcctacaaattttaccttcctcagccattctttgcatacgctggaagtcacttcgttcaaaacttgtaccggaaatcccgtcatctacaaagaacattgtatttttgtagccgtgatttttacaataatcaagcaagatttgtttctgattacttatactgtttgattcatcatcggatacccttttatctttttcatcctcgacagataatctgcaataaagggcagtgatgagctcatcgtttgtttctgctgtcataattttacgctcctttccgacaacaggacataacaaagatatatttattttattacgccctgtgtcttttggctattgtatgaatatcaaattggcttttcaggcaatatcagtttctgaaattgctgaagaacattttctctgccattgggattaaaatgtgtgctgacttcgtaagttgtattgcctattttcataaagaacggttcatcattcttttcaaaatacggtgcatatattgatttgtttttatctgtcatcgttcatccctcctgtttctttctctttgcttctgccatttttcgagcagagatattattgttttctgcatatcggatttggtgtagtttttcggaaaatatttgcgtatatcttcttccataaaacgaacctgttctttttgattgggcttttcttcacacaaaacggcaaacacaacatcggttgaatatttgccttattcactgaattttctcaatcgctgtgcttgtgataatgacggtgtagcgtctgtaaattcgatttggtcaagcaatattctttgctcatattccgatagatatgaaatctcaaccgcaggagtaaaggctaaccgttccttgtccacaagttttaagagctcaggtattaagtatgtcaggcgaatatatcgctgtacttgtctgccactttctgtgtcagatatgttatctcttgacttgtggacaacttgtccataagtttttccctgatgctttaaggcttctaatttcattttgtaggcaaaggatttttcgcttggtaagatatgttcacggtgtacgtttgaatccaccatttgcacaatcgcctcatcttttgtcagttcttttattatcacgggtatgcttgttacacctaatgctttgcaagcttcagctcgtctgtgtccgctgataatttcgtatttaccagccggaaaaggacgggcaattatcggttcaagcaatccattttcttttatgctctctgttaattcttgttgctcaattccgcttctttccttaaacggatgattttcaaagggaacaagcgagtctatatctattatctgtatcatttggctatctcctatatattttcttcttcggcaagtaatgtcttactctataagtcttaataccttctgttattcggaaatcaagaaagctgaaaatcagaattgttttagatagataatgcttggctttccctgaccttgtcttttacgaagaatcaaatccgcagtttcaagttcagaaaacaacttacatattttttcgtgaccgaaatgcagtttttcctgagcggattttattgtgcaatattgatatactctgccttgtttatctatccagccgtttttgacggacagatacattcggtcaagtaaaagtccgtacagcattttggcgtctgttgaaactgatttgtacttttcttcaaataacgctttaggtactttgtagaatgcaaagtttttggcattcgatgttttgaaatatctgttcactgtgttacctccgtttctgtactgatttggtgccgaaatcggcaattctttcgcttatatgagcttgaaattctttgtaagtgttatttatcatcttttgtaattacgctcctttttgccttgaatttgcggcagtaaacaataatgacacgataactttgtttgcaatcgctatgacattttctgcaaagcttgttgtatgttcttctacctgtattgggggttatgaaaaatttccattcttgttttgctttctttgataatctcggcattataaaaactcctttcactcatttggacaaagggtgccaaaatgcacacccaaatcggataattaaaaagaaaaatacttttcagcgcataaaccatcagggggttccttgaactcttataaaatttattccttcacttattaggaatttctttgtgttttgcccccttgttttgtaaaaataaagacccatctgtaaaaaagtacagatgggtagaaatccatattattttctgctataataatgctatctcatcgacatagaattattaggagatgaaacatgagttattcagacgaaataaagaaaattcgtaaaaaatgttttctgtctcaagaagcttttgggagagaaattggagtttccttttcatcaataaaccgttgggaaggtggaaaaagcaaaccgaatatggctgctatgaaaaaacttaaagatttttgtgatattcatggtattgactttaccgccttggaagaacaatggaacaatttgggaaaggacaactaaaattatggcaaagaaaaagacagaggatacaatcaatctcgattcaattctttttaaatgtagagacatcttacgtgcagcacgtaattcgggttcattttttgaaaaacgtgatatgatgctgacactggtatttttaagatttatcggagaaaaatatgaggatggtatcgaaaaattacgccaaatcttaattgaacaagggcttgatccggatgatgaaaacattcgtgcagcattctttgatgatgccacatttgcagatggcacatataatctatcgcctgaggcaagatggtcaacaattataaatacacctgctcccaaactgaatgttgcattagacaatgcacttcatagtattgctgccagttctaagcaattaaaagggtgctttgtggaaggtacatttactacacgcaatcttgcaccgaatgatatcaaaaaactgattgatgaagtcaataaaatcagccataagaagttcggagaagaaaaagaccttattggtcgtgtttatgaatattttctgaaagaatttgctgttaatgccactaaagaagaaggtgaattctatacaccgcacgatgttgtacagctaattgcaactatgattgaaccgtatgacggcacgctgtatgacccttgctgtggttctggtggtatgtttattcaaagtgctgcactcgtaaaatctaaacaaggcgatattaaccgtatcaatgtatatgggcaggaaaaagaacctgcaacatatcgtcttgcaaaaatgaaccttgccttgcgcggcatcagccataaccttggcgaaaccagtgattccagctttctgaatgacctgcacaaggggttgtacttcgattacattatggcaaatccgccatttaacctcaaaagctggtatgacagtaccttggagcatgaccctcgctgggcggattaccagacgccgccggagagcaacggcaactatgcgtggattctacatatcctctcgcacctgaaaaagcagtccggcgtgtctggtttcctgcttgccaacggcgcactgaacgacagtgacacattggaaattcgcaaaaagctgatccaaaatgataaggtggaagcaatcatcgtcctgccgagagaactattcatcaccacagacatcagcgttaccctttggattttgaaccagaacaaaaagggcggtagctaccacggcagaaatctgcgtaaccgtgaacacgagattttattcatggacctgcgtagctggacggaaaacccggtaaagggcgagaacaagaagaaagtcctgctggacagcactcaaatcggaaaagccgccgacatctaccacacatggcagagcgagggcacggacggcagctgctatgaggtgccggagctgtaccgcagtgtgggtattgatgagattgagcagaacaactgggcgctgaccccgagcaagtatattgagttcatcgaccacgatctggaaatcgactatgaaaaggaaatggctcgtatccagtcggaaatgcaggaggtcatgaagcaggaaaagaaatcccagcagatgctggaagatgcattcagggggattggctatgggattgagtaaatataaattaggcaattgtgtcgaattatattccgaacgctgtaacataccaaatcttacagaatgggatgtgtctggcgtaaatagggataaggagtttttcgagccttcaaagcaagtcggcgaaaatacaagtaattataaagtggtgccagtggattattttgcctgtaacttaatgcacgtaggtagagataaagtgctaccaattgccctgaatcatactaacaaagaaaaatatgtgagtccagcttataccgtttttaagattaaggaaaatgctcagattctgaaggagtatttctttataatgctgaaatccaatgaacaggatagatatttctggtttcatacagattcctctattagagatggtatgtcgtgggaggatttttgtgaccttgagattagcattccgccgcttgtcatccagcagaaatatgtagctgtctacaacgccatgcttgccaaccagcaaagctatgagcgtggattggaggacttgaggttaacttgtgatgcgtatatagaccagctcaggaacaaatataaatcacaaaaacttggagcctttatttccatgtgtgaagaaaagaacgaaggactgcaatacagtattgatgatgttaaaggcatatctattgaaaagaaatttattgatacaaaagccaatatggaaggtgtgtcgcttcgcccgtatgcagttataaagccagacgaatttgcctatgtgacagtcacatcaaggaatggtggtaaaatttctctggcacacaataatacgcaaaatacttatatctgttcttcttcctatatcgtttttacgataactgatacagatacgctattgccaagctactttgccatgctttttaggcgtagtgaatttgaccgttacgctcgttttcattcctggggaagtgcgagagaaacatttgattgggaagaaatgtgtgatgtggaaattcccgtaccgcctatagagattcaacaagatattgtgaacatttatgaagtatatttagccagaaaagaaattaatgaaaagctcaaaagtcaaattaaggatatttgtccaatcttaattaaaggttctattgaagaatcaagtagatgaaaggaagtgtgacgtatggcaaagctgaataattataacggtcgctattgcgagtcggaatatgaaagtgctttcatcgcttttttgcagtcggttggttggacgtatctgccgggaaataagattaaacgctgttacagagacgtgcttattgcagatgatttcagagcatttattacaaaagcaaatacagacttgttggaagaagaaattgagcaaatttatgatactgttcgccttgtcggtgcagagagtgattttgccactttgcataaggtctataaatggatggttgacggtattcaattcacaccgcaaagtggtttaccaatacaggttactcttattgattttgaaacaccagaaaacaatatatttcatgtagtaaatcagctaacagtagactatataaataacggacaacgtgaaaaccgccgaccggatgtgcttttgtatgtaaatggcatgccactatgcattatcgaattaaagaatcctgccgattctcattctacaatttatgacgcatgggagcagattaccattcgctactggcgtgatattccgcatttgctacattattgccctttagcgtgtatctctgatggagttaaaacaagattaggaacggtacgcacaccttatgaacatttctatgcttggagacgtgcaaacgatgctgataagatttctaccatgccttttgcagaaaccgaaactatgattaagggtgtgtatgcacctgagcgtttcttggaaatattccgtgattacatttattttcaagatgaaattttcgattgtgatgaacgtgaaattgtttgccgttatccgcagttctttgctgcaagactgcttaaacagagtattataaaatccgttatggagcaaacaggaaaaggcggtacatattttggtgcaaccggatgcggaaaaacatacactatggcgtttcttgccagacagctttcacttcgctgcactgatattcctgaaattggctctccgactatcgttatgattgttgaccgtgatgaacttcaggaacagggaattaagctatttgccaagagcaaagaatttttaaacctcggtgaagtttctatagttaaaagtaggaataacctcagacaagaacttggcagcagagaaagcggtggcttttatatttgcactatccagaaattttgcgaccgtaaggaagataaaattggtctcattaatgagcgacataatattatttgtttttctgacgaagcacatagaacgcagttggagcattcaagaaaaattcagtttagtaaagatgccgatgaaaacatgaaagctatggtttctaagccatatgcaaaggtgttaaaggaagcatttccacatgctacatttgttggatttaccggtactcctattgcagaaacttaccaaacttttggcgatgaaattgaccgctatacgatggaccaagctgttgcagatggattaactgtatctatcaaatatcatccgagaattgcgaaagtccttttagataccaaaaaagtcaaagaaattgagacttattataaaacttgtgctgatgatggtgctaccgaggaagatattgaagcaagtaaaaaagctatgagttccatggaaattattcttggagagccttcccgtttggaacgtcttgctgtagatattcatgatcattatgtatctgcttgcgataaagaacctgacagaatacaaaaagcgatgattgtttgttctaacagaaaaattgcttatgagttactcagaaaatttagagataaatatccagaatggtttgaagaaaagaaaattcccgatggcatagaagctataaaggaagaacttgatgaattaaaacctatgccgtttatggctatggttgccagtgttggcagcaacgatgagaaagaaatgtataattaccttggcggtgtaaaaaatgatagacgctcaaaggaattagatgctgcctttaagcaggaaaaatctaacttccgtatagttattgttgttgatatgtggattactggttttgatgttccaagtcttacgtatctatataatgataagcctctaaaaaaacatctgcttattcaaacaattagtcgtgttaatagggtttatccaggaaagaaatttggtatggtcattgactatatcggaatccgtgataatatgcgtgaagctatgaaaatttatggcggagatacatctgttgcacccaccgaggatgatgtagaacaggctacccaagtttttagagaagaacttgaaattttaaagactatgtttaccggatacgatttgaaaccatttttaaatccgaacggagattctgtagaacgttattgcttgcttgccaaagctgcggagtacgtgttttcttctacagaggaattaaattctgaaggtaaaaacggtacacaaaaggtatcatttaaaacctattttttaaagactgttagaagagtgcgtcttggctacgatattgctcaaccatctggcgatttatctgacagtgaatccgctttggcacaatgctttatggcaattgctggttttgttcgcaaaatgagtggtacaactgagcttgatacagacagtatgaatcgtgctgtttctaaaatggtcgacgaggcattacgttacaatcaagtggagagtgtccttgatgctggggaggaagaggatatctttagcccggagtattttgaaaagctttctgatgtaaaaatgcctgccaccaagctagagctacttataaaaatgattcgcaaacagattaaagaatacagtaagattaacaagattgctgcaaagacttatcaggaaatgcttgaagaaacgattgctatatatcatgaaagacgaaaacatattagtgcagaagaagctggagctacacaagaacaggcatctgaagatattattaaaaatgccacggaacaagcattacagatactccgtcaaatgaacgaaagccgtgaaagtttccgtaaaattggtttaacctttgaggaaaaagcattttacgatattttagtatccttacgagaccagtataattttgaatatggcgaggataaagacattggtggtatgattgtaaatgatagatgtaaaagtcttgccaaaaaagtgaaagagataattgatacaaaatcttctttttctgattggcttaacaaccaaaatgtacgcaatcagctcaaacttgatattaaaatttgtctcgtaaagaacggctatccacctcaatatagtccagaggtttttacaaaagttatggaacaagtagagaattttgaagaaaattccgatatgcctttggctactacttatacatttccacaatctcgtactgtatctatggtagcggaagatatcattccatatggaaataaatcggagaattgatgaggaacggaaatgaaagcaaaaaaatggctaactattattacattggttattacagccttgtcattagttcttgcctttatcattggcaagaatagtaattgtataacttatgacatatctatggcgattttcggcggagctgctcttggctttataatgtcattaacagaatattatgttgaaagacgaaaagcaatggaagaattttggcttcaggcaaccaaggtattaaatgaattaaaaaagataaaatatcttgatgtggatgcacctataaatttaattgttgatgcaatacatgaagacgattcaaatgcattgaagaaaaaatttcatcttttgagtgatgaagaaaaaatatcagttaatgcaaaggaaaatttgatttcttggtataaagaaaacattcccattccttttgatgaaaatactgataataacaaggaattaactcagctatatgattcgaatatggctggttacaaagaagttttccttcaatgcatggacagctatcgagaggcatcaatggttaaactgggaaatcttgacaacgcatacgggaacttggattttattatagctaataaatgtattcgacaaaaagcatatgagcaaatatatgataaactgagaaaaattgtttatcagtttcagaacgaagcataccattttaatctattaaaaaatggaagtggcaatttttcagtatgcattttaaaagtatctgaacttaatcaggaatactttttgtcaaaagaggaaaatctccaagggtatactaatgtttcaatatttcaaaatgtctttgatgatattgatgcctcattagagaattttagatgcaaaatatatagaatcgaatatgttgaaccaaaagcaatacctgtttccggtaaaacatttttcaacaacaacgaaaaatagaattcgtattttgaaatttggtaatggagtgtgcgtaatcgctaagcaaaaattattatccgggtattagggtatccctaacgaatgtcttaccgtttggataaccaaatggtctgctcgctaagattatacattttaatcaaataaataaaattaaggcacagcctacggtatttttctccgtaagttgtgcctttttctcatctataaattacttgttcattaacgatttctgttgctcggttgcgaatattattcatctttcgcacccacaacatcatatttcctgctttgagtttttctgtaacttgctccttttcgacaagtgattttactgtctgttcaaataaattctctgcttgacactcgacaccgtcaagataatcatagagcctttcactcgtcagaagattataatatcgcaccttatgcctctgctttaggtattgcttgtgacggtttgcgcatacgcctaaatgtatttcttcttgcttcttggttcttacgcaagggataagataattgccttgctgttcatactgcacattcatggtcagccctcctgataaattattttgaaattctttttctttgcaccgataaactctacaagcacatcatcgactgcatctgtatatctgccctgtgcgattaactcgtttctcaggttatttagtgaattgataattaaactgtattcgttattggtcagtgcaagatggtatttgatagttctcattgcgaatccctccttgactatattctactcgactgatttttaaattgcgaatgtgtggattttcaaagcatagaaaaaagactctgaccttttacagtcaaagtctttctctggtgcgccttgcggcgcacgtttctaatgggtgaaagtccctaatccaccctagtagtgggaaggatacagccgagaccaagggtgtcctgttcatagaaatgattatgattaacgtgaggggaatctgaaggaaggtggaggcaaatctctggtctgacgaacagaaatcacataaggctattattgaggacaagactgccagacaagtcaaagtccaataactactcggaattaatgatagtaaatgtggcagatatatggagagaaagaaacgtgtggtaccaagggaggtctcgtcagcggatggaaacagagtaagaaatccgtcagtaacaacgaatgacgagaagtcagcagaagccatagtaaactgatggttgcaaacatcagcaaagggctgaactttaggagacacaagcaatgaaagtaactgaaagtggatttaataacagacaacttcatatggaagactatctgcaaatggtatctgcggaacagaaagagtatgcagaagtgttagaccaccagaagattattgaaaagagcggtgtcatcacagattattggacggacaatcttctggatttgattttgcgaaaggataacctaaatgcggcttataagaaagtaaaatcaaacaaaggaagcggtggaatcgacggaatgcaggtggatgaacttctgccctacctgagagaaaaccaggaaactttaatccaagaaataagggatggaaagttcaaacccaacccagtccgaagggtagaaatacccaaagaaacaaaaggcgagtttcgcatgcttggagtgccaacagtggttgacagagtaatacaacaggcaatcacacaggaactcacaacaatctatgaggatcaattctcggaaaatagttttggatttcgccccaaaagaggagcgcacgatgccctcagacaatgccaagagaatgtaaacgaaggttacgtatatgtagtggatatggacttggaaaagttctttgacacggtatgccagagcaaactgatagaggtgttgtcacgaaccatcaaggatggcagagttatatcgctgatacacaaatacctgaatgcgggagttatagcaaatgggatatttgaacgtacagaaataggaatgccacaaggtggaccattaagtccgttactaagcaacatcatgctgaatgagttggataaggaactggaacgcagaggacacagatttgtccgatatgcagacgattgcatgattttctgcaaaagtaaaaagagcgcagaaagaaccttgaaaaatatcattccattcatagagggaaaactttttctcaaagtgaacagaaagaaaacgacagtggcacacgtcagcaaagtaaagtaccttggttatagtttttacagaaataagggaaaatgcagatttagagtgcacccgaagtcagttgcaaagatgaagaataaaatcagagaactgacagacagaaataatggcatgagcaatgcaaaaagagaagaaaaatatcaacaattcgtgcgaggttgggtaaattatttcaaactagccgacatgaaaaatcttctcaaagatacagacgaatgggcaagacgcagaatcagagcggtctattggaaacaatggaagaaaatcaagacaaagtaccgaatgctgaaagcattgggaatggatcattggaaagcgaaagaactcgcttgcagtagaaaaggatgttggagaatggcgcaagtgctaaaccaaatcttttcaaacaaaataatagccaagttaggatatatacccatgcttgactattatctggtagtttgtgaaaactaaggaaccgccgtgtacggaaccgtacgcacggtggtgtgagaggtcggctaatcaacaatggttagcctcctactcgatttctttgcaatgccctataaagttgtattcttataatttttaagttactgccttatgtggtgttagcaaaaagtttctcctgttttttttgcaagaataagccaaagtatggtatgatataggcaggtgactaaaaaagagggattgagcgaaaaaaatgaaaaaactatgggattgggtgaaggatgtttgggtatattcaggtctgtcaaaagaaaactatgaaaatatccagcaaagtgtggcgcataaaaatgcaagattgttaaaaaatgcgattcgttcttttgaagtgctcacaggagtattattaattgcagcgttctttttttcacaattaaatgcgttgaagagttttttgattcttacttttatcggtatgatgatgatggaaattatagtacgtgtctgtgatttgaataattttagaacacttcggagtgtctgttatgtatttctaagtacagtttatttatttacagcgatttcgggtacagttggaagtccgaaacagagtgcaacttcatattttattttattgtttgtaggaccgcttttgtttattgacaagccatatcggatggcgttgcttctttgtattatgacggtgatttttcgatctcttgcactgcattataaagagccggagattgcaaattttgatgtatcaaatgcaatctgttatacgatacttgcgattttattatatcttttgaccagtcgtaccaaagcagatgagcataggcttagatgggaaattgctaagcagagagatacggatgagctgacaaagcttttaaccaaaaatgcggtagagagaaagataaaacagtatatggaattaaatccgtccaagccggcaatgatgcttgtaattgatttggataattttaaacatatcaatgacacgttcggacatgtttatggagatgcagtactacgtttgatgggagaatgtattagaagtaatttcagagaagaggattataagggaagatttggcggagacgaatttgtagtatttcttccggatgtagatgataagcagcaggtagtaacttatgtcaacaacctggtagaaatgatgaaaactcgtgtcagaacaccggagagtgcaaatccggtacatggaagtataggaattgcgctgtatccaaaacatgcctctacttatgaagaattgtttaaaaaagcagatgaggcattgtatgcttcaaaagaacggggaaaagaccgctatacattctatatacccaaagaagtattaaaataaaaatcgaaaaggatttggtgagttattatggaagaattatatcaggcaattgaagaaaaaataaaagcttcgggttatccgagagcaatttcaggagcagatgtgtacgatgatatctgtgaccagattgaaggaaaagagaatggaagttatttattattatccaaatttgaggatgatgtaatatttgagtaccatgtgaccattcaggatgaagaatttaatcttgggattttgaccatgcgtactccggaaggaatatttgaagctgattttgataaatagaaagagtggctgtcgagttttcgacagtccttttgttttttcatagcgtttgtcgaaaaaacatagtataataaaaaggaaagctatttttaaccgaggaaaagagggctcaaatgggtgaaattggacagatttttttaaatctgggggaatattccggaccaatattaatcgggctgctggtgggagtttggttgttcgggaggtttctgaaattaaatttaaaagaaaaaagaaaaagaaatcttcaggatgcaagagatattattattctgaaatagaagagggagaatcggaaatccatattatgagccaggtgaagcagatggatgttatcctgtattgcacaggtggcatccattttgtttttgcctgctattactatatatactatatgcgttttgtacctcattgaacctctgggaaagactttgacatctaatcatgggtatgatacactgaacttaactatgggtattgtgtcatggtatggcaaatattaatagtagaaacttaatatacgttatatatttagtacaaacacagcaaaaggaagtatcgaatgtacagctgattttgagcgtacatgaaactaacagaggtgaaaatattggataaaaaggaataccgtgcgagactggatgagattaacaatctggtagagaagcaggattacagagaagctctgaatgttgtagagacgattgagtggagacgggtaagaagtgcaagaactctttgtatggtaagtgaaatctacgaggttaataaacggtatgatgacagtctcagactgcttctgctggcttatcagagagcaccgagcggaaagctgattttatatcgtctggtagagttgtctgtaaagatgacagattatgaaagtgcagttaagtactataatcaatttatgaaactctctccaaatgataacaaccgttatattttgaaatataagatttataaaggaagaaaaaatccgattgaggatcagattaaaatcttagagaaatataaagcaagtgagtatacagaacgctgggcttatgaactggcaagattgtatgcaagagccggcatgtacgataaatgtatcgcagaatgtgacgagatggttctctggttcagcgacggaaagtatgtaaagaaagctctggagctgaaaatgaagtatacggagctgacagatgcggagaaagaaaaatataaggaactttatggagagccgaaagcagtacgtattgcaagaacagcggcaagtgtaagtgcggcaactcaggcggcagcaaagatgctcaatcagactgcgcagactatggtaaaaccagaggaagcagtaaattcagttaaagcagaggcatttcagattccgaaaccggaggcgattaagaaagctgaatctggggcaggctcagaagcaaaagcggaagaggaagtaaaaccggaactggcagaacagccgaaaataatgaagatgccggaatttattaaaactccggaagttaaaccagattttgaaccacttccggaaattcaaatgccggaagaaatcaaaaaagaaatcgaagaagaactcgaaaagaaaaaagaggtagaagcaaaactgcaggaagaaacagcgaaaattgcagaagaagaacctgttaaagaatttgatttagaggcggcacttggagctgcggcagatgagatggttcaggaagaaaaaactgaagcagtagaaaacgaagcggaagcaaaaacagaaatggaagtgtcagaaggcgcaactatccagcttccgttagaagagataaaagcagcacgtcaaaatgcagtagaaaccgatgcaacggttgatttatcaaatgttgtagaagaagcaatggcggaagcggttgtgacagcggaggaagaaacagcagaaaaagcggtagaagctgaaactgaggcatcagaggaagaagtggctgaagctgagacagaagagccacaggaaaatgaagcagctgagtccgttgagacagaagagcagcaggaagagaaagtgacggaatctgctgaaccggaaccgattgaagtagaagaagcacgagagagtgaaccggcacagtggatgcttgaggagccagtggagtcagaagaagaaaatgcagagccggaagcagaagtagctgaagaagtagaaccagaaccggaaaaagtgcttcgtcatcatttgacagaggaagaacacagacgactctttacttattttgcaccaattccgggaatgaaagaacaggtaaaagaagctttggatatcgcacagaaatctgcgtgtgaaaagacttccaaggcaggaaatatgattgtaactggacgttccggttcaggaaaaaccagattttcagaaagcctgattaaagcactttgcaaagaacgccagatggaaggtgcaaaagtggcttacctgaccgcagaggtgttaaataaaaaagaccctgcatttattgtagataaactttcaggaggatttctggcaatcggacgtgcatctgcaatgactgcccaaacagttgagaatctttccaaagcgatggaatttaagaccaatcgtctgactgttattttggaagattcaaaagccggaatttatacattgaagcaggattatccggaatttatggaaaaatttgattcgaggattgtaattccggtttttaccaatgacgagctggtgtcattcgccaagacttatgccaaggaaaaaggctataaggtagatgatattgcagtacttgcggtatattctttgattggcgataatcagtatgaagatgacccagtctgcgtcggacaggtaagggaaatgatggatagtgcaattgcaaaagcttccagactgggtagacgtccaggtaaaaaagtggcaaaacgtcatctggatgtaaccggacgaattatgctgtatgaaaaagactttaacctgtaagatatcataacaggaacagtttgcagataaaaatatagataaaatttgcagataaaaatagagtctgcagataaaaaatatagatgaaaaagcagataaaaaagggagaaaaaaatatggcagtcccatatcttggaaattcaaagaatacgattgaagtattgcagaaatatgattttgtttttcagaagaaattcggacagaactttttaattgactcccatgtacttgataaaattgtaagcgcagcaggaatcacgaaagatgattttgtactggagattggtcccggaattgggactatgacccagtatctggcagcttctgccagaaaagtgtttgcggtggaaatcgataaggcgttaattccaattttggaagataccttaaaagagtttgataatgttcaggttatcaatcaggatatccttaaagtagatatcaaaaaactggcagaggagcacaatgacggaaaaccgattaaagttgtggcaaatctgccatattatattacaacgccgattatcatgggattatttgaaagtcaggttccgattgattcaattaccgtaatggtacaaaaagaagtagcagaccgaatgaaagttggtccgggcacaaaagactacggtgcgctgtcactggctgttcagtattacgctgagccgtatatcgtggcaaatgtacccccaaactgttttatgccaagaccaaaggtaggaagtgcagtgattcgtctgaccagacatgaaaaaccaccggttgaggtggctgacgagaaattgatgttccgcctgattcgtgcttcttttaaccagagaagaaagacccttgcaaatggattgaataattcaccggaattgtcttattccaaagaggaaatccagcagactattgaaaaatgtggatttaaagcgggaattcgaggagaagcactgactttgaaggattttgcaaaacttgccaatgcattttctgaaaagtgaaaaattcaagaaataaaatgaatacagaaaaataaatacagaaataaaacgaaaagccatcgcccagaatatccgaaactgggcgatggcttttttctataaatattaaaggaaggagagccggtcgtttgcgaccgacatatgaaaaagaaaatataaaaataatttttgttctttattatttttatggttttagtatattcgataaatgtgtgcaaatcatgttgaagttgtgaagaaatcatgaacgaaattcaaaacttttgtgaatgacagattttatcgtattttgttggaagaaaaattttcaattatcaagtgacgaatatccagaaaacgttcgacaccaatgcggattccccccatcagaccggaaatatcctgaagccgggaagggataatctggcatttacgattctgatgatggtgcagatagtcctgaatcgagaggttaatctgcggaatataattagaaaacgagctgttgagcacgaccagttcaatattaaacgtattaataatattgttgattgcaattgaaatatatttggaaaataattccatcatttcaagtgcttcaggaacctggttctgatagtcacggacaaaagcatctatcgtaacctgttcctgatgggtgagtctggcatattcttctaaaatcgctttctcagaggcatattgttccagacatccatgattcccgcatgggcagggtttgccgtcgggaaataaaattgtatgtccgatttctccggcatagccgtcctgaccacgataaagatgaccgttaatcataattcccataccaattccatcatgaatatttaataataccatgttttggtcataatgatgaaatgccgattcaccgagaacagacaggttcgattcattttcaacaaaaaccggaatgtgaaactctgattcaagcagtttggccagattagaatccggaagcggataataaggagtaaaaagaatctgattttgttgtacaacaccatagattccgatggtaattcctacgattttatagggacaatccccatactcaggcaggatatcatgaattatccggcacagatttttgtataaattatctcccttttggaacggatattcttttaaacggcagttttctccttttaaatccgaagttaaagcaataatctgagacggatgcacgtcaatagaaagtgcatatccgcattttttctgaaattcaagtaaaataggttttcttccaagagaagtctgagcgcttccgatttctaaaatcagatgctgttcaatcagctcctgaacgatattggaaatggtcgcttttgtcagatgaagctgctgagaaagcgcagcccttgagaccggtggatggtttacaagatattcaagcacctgcctgcggttattgtcgcgtatcatttcctgatttgcaatagccatgaaaaaaatccctcctttaagtgaaatgtactcttgaaaaatcagccgtaaaatcaaatacagaaagattcggagagtacattgcgtgtattatttatcataccacttttcttaagtggcgggcaagaaaatttgtataatgggtaaacaaaacgtaaaggggcagttgaacgcagataagcattctcacacttcaagtgcgcagagcgctaagcagtgggtaaggagtttgcttttggggttgattttgcaaaacgattaggcagaaaaaagtttcggataaaatttcttaatgaaaactttagatgcataaaaacagggagtgtgttatgatgagggtgaaactttgaaaggagatttttattatgaaactcaacaaaagaaaattagcgttactgatgacaggactgatgctggtcatgtctccggtcagtgtatgggccgatagagaagatgcaaaactggagaaaccttatgtatccttaggtgcagacttaagtgcaaatgaccgtgcaatcgtattaaaattgcttggtgtgacagaagatgacttgaaaaattataccgtaacaacgattaccaatgccgatgaacacaaatatctggattcttatctgagtaaaagcgtaatcggaacaagagccctttcttctgtactggtaaaaggaaaaactgacggaagtggaattaaagttacaacctacaacattacttactgtacgaccggtatgtaccagaacgccttggcaacagcaggaattgaggatgcagagattgtggtagctggtccttataatatttccggtacggctgctctggttggagcaattaagtcttatgagaatatgacaggcgaaactgtcagtcaggaaaatgtagacactgcgacaaacgaactggttgtgaccggaaaacttgcagaaagtgtaggtgattccgataaagcagaacagttagtcggagcagtaaaagaacaggttgtagaaggcagtgacaatggaaaaaaactgacggaagaagaaatcggaaatgtagttgaccaggcagcacaagagatggatgtccagctttctgatgaggaccgtcaggaaattgttgctttgatggataaaatcaagggactggatattgatgtggacagcttaaaagaacaggcaaaagatttatatgataaaatcgatgatttaggattaaaattagactggaatcaggaaaaagtacagggattcttctctaaaattatcgaatttttcaaaaatttattcagctaaaaacgaatagaaatagttccatggaacagttatatgggtaaaaaccgggggaagacgtctcaaaaatgtcttccccctttcatgttactcattttctgttgcgctgtatttctgaattgcctcatttagagatagcatacgctggtctaattgagccacaatcgtagcacattcctgtaagtctttactgatgtaatccggtgcatttccctcaaacttgtaataaattttatgttccaggcttgcccagaaatcctgtgcaattgttcgaatttgaacttctacgggaacatagagagtcttatcatagagatagaccggaacagaaaccagtagatgataactttgataaccgctctcttttggctgtttcatatagtcttttatgttctcaatgcgcaaatcattttgcttacgaataaaatcagcaatcagataaatatcagaggtgaaagaacagataatgcggattccggcaatatcgtttacatatcgaatcatgtttggaatatttgattcgtaaccatctttttttaatttttttacaatgctttccggagttttgattctcgattttacgtgttcaatcggattataatgctgaatatactgaaattcgtcgtttaagatatcaattttagttgccacctgttttaatgcggcatgataaagaaacatcatagtttcccagtcattgacatctccatattctctttcaaaaattgaattatttatagtatcacttccttttttgtcgcttctgtatagtatagcataaaagataaaagatgaatagaaagaaaataaaaaagagattttccgaaaaaggttgacagaagagaggggacgttgtttaataaaattattatattaaacgtttaagtaaaaaagaaggtgaaaaaaggaaaatggcgacgattaaagaaatcgcaaaggcatgtcatgtatcagtggctaccgtttccaacatattgaacaaaaagccaggtgcaagtgaaacgacaagggaacttgtactcaaaacagctaaggaaatggactatatgccaaattatgtggcgaaaaatcttaaaacaaagaatacaagaagcataggtgttatagcggaggacatgactattttcagtattccggatattattgacgggattacggaatactgtgaggaagttgattatcagattttacttacgaatttacggctgtataagaagtatcaggatgtgtattatggcagggaagattattttgaaagggtaaaacaggaaataaaaaagcttatggcaaagcaggttgaggggattatttatgtgacagctcatgagagggtgatgcattgtattccggatgacctgccgataccggcagtcatggcttatggatatacggaaagcaaaaaagtgccgtcgattgttgtggatgatgaacatggagcgtatgaggttgtctgtcatctgattcggcatggacacagaagaatcggtgtagttatgggaaaaaaggatagtcttcatgcacaggcacgtcttgtcggataccagaaagcactgcgagacaacgggattgtgtatgatccggaacttgttgcacagggagactggacaagagaaagtggatatagaatggcagatgaactgcttgcacatgatgtgacagcagtcttttgtatgaatgatcttatggcaggcggactttatgaccgactggatgaacttgggaaaaaaataccggaggaactttctgttgtaggatacgatgacagagagttatcaagttattataagccaccgctcacgacaatccgactgccgctgcatgatattggatatcgtgcagcagaagtgatgattgctttgctggaaaaacggattgtaccgcaggaagaagaagtgatttatcagatgccttgtgagatgttaattcgtaagtctgtgcaggactacaaattatagtggtacaagttgtgagaataggatacaagcaatgaaaaaaacagctttttgagactttttttaaaaggttttggaaagctgtttttcgttaaaatatacaaagaaaacaggacttgaaattgataaatattaggattgagagggaaaatgttgtgcagtttgtacatacttaaacgatttaaaaaaattaaaacatgtagaaaagatggaaaacaaagaaaaaatgagataataagaaaaaaaaagagattatagagatattaatcgttaaaaaataaaatttataagctttttattgtgtaaataatgtggtataaataagaaaaacaaacaagagcgttgtacaaaatcaataatgacagacaagattcgggcagattagacaaaaaaaggtcggaaataggaatcaagttcaaaagagcggaacatttaaatgttaaacgtttaattgaaaaatgtcagtatttgtcaaccaggtatcatgcagaagcaggaggcttctgagttgataaaattattaaaggaggacactataatatgaaaaagaaagtgttagcagcattattatgtgcagcaatggtaggaactacattggcaggttgtggttcatcaggcagtgattccggaagtgatgattccgcaaaacaaacaggtaaaaaagaaatggatgtagagggagatgacgttaccactcttaatgtatggacattcattgaaaaccatcaggatttctacacagatatggctgaaaagtggaacgaagaaaatcctgacagaaaagtaaaactggtattatccaacatggcttatgatgatatgcacaacaaactgtctctggctctggaatccggagaaggtgcaccggatgttgttgatatcgagttaggaaaattcccggcatttatgacaggaaacatcggactgaaagacttaacagatgcaattgcaccatacaaagataatgtagtacagtccagacttgacttatattctaaagacggtaaatgctatggacttccaacacatgttggtaccactgttgcattctataatacagaagctttagaagcagcaggaattgattacacaacaatcaaaacatgggatgactttaaagaagccggtatcaaatatcacgatgcaaccggaaaaacatttgcagcagctgaaacaactgcacagtggacactgaacctgatgttagctcagaaaggtggaagctacttaaaagaagatggttctcttgatgtaaacaacgacaagatggttgaagtattacagtgcatgaaagatatgcaggatgcaggtgcacttgctacaatcgctggtggacagcctgataatgaagaagcttatcctctgtttaatgatggagaggttgcagcagcaatcatgccattctggcagacaagccgttacttaagttacatgacagacctttccggtaaagttgcaatcgcagctcctccagtattcggtgacaatgatgccgttaagacaatcggtggtggcggtaccggtactgcagttgtagcatccggtgaaaatgcagaccttgcagcagacgtatttgcattcatcaaactttctgatgaagccaacgtagaagtatggaacgtattaggatttgaccctgtaaatacagaagtttggacacagacagatattacagaaaatccagacaaccagtatgtaaaatacttcaatacaaaaccatttgatacactgttagaagtacaggatggcattggcttattagactgttatacagatgaaaaaatgccttctattaacaatgtatttacgactcagactttaaatgatatctttgaatctggcgtagatgtaaaagaagcacttgatgaagcacaggatactctggaaaacgaattcgcagaataatcatttgtaagtgataagaaatgtaatataagaagagcgggatgtggggaaatcccatgtcccgctcttattagagagaggagtatatatcatgaacaaggtaaaaaaattcttttactcacagaaagccgctccttatgtatttattcttccatttgtattgacaattcttttattctggattgtaccgattgcaaatggtgtacttcttagttttcaggatgtactcaaagataaatgggtaggctttaataactattcgagattgatttcagataagatgttctacaaagcaatttacaacagcgtaaaatacatgattggaactttgattttactgattccatttccaatgttatttgcaagtctgttaaacagtaagctgatgaaaggtgcaaatttcttcaaatctgtttacttccttccggctttaacatctgttgtagttgcaggtactattttccgtctgatgtttggtgaaatggacaccgcactggcaaaccagattatcggtctctttggacattcaccaatcaaatggttaaaaggtgagtggaccagttactttgcactcctcttggttgcatgttggagatggacgggtgtaaatattctttacttccttgcaggtctccagaatatttcaactgatatttatgaagcagcatctatcgatggtgcaacaaagtggcagcagtttattaaaatttcattcccattattaaaaccaacaaccgtttatgtgttaacaatcagtatctatgcaggtttgtctatgttccttgagtccttcatgttatggaaaggaaataactcaccaagaaacatcggtcttactattgtaggatatctgtacagacagggtattgaaaagagagcaatgggatatgcgtgtgcagttggtcttgtactgttaatcatcgttatgattatcaatatgattcagcttgttgcaacaggaacattcaagaaggaggagagataatatggcagcagaagcaattggaaaaagccagaaaacaaaaaacagagtggcaaccgtgcttatggtaattttctttacgattcttgccatcttgattatcctgccgatttatgccattattctggcaagttttaaaccgggtaatcatcttcttcagtatggtttgaaccttgatttagacagtgcaagcatgacactttcaaactacgtgttactgtttaccggtcaacatgactactggatttggtttagaaacagtttattcttaactgttgttactgtagtattaaccttactggtaagtgctttcgtagcttatggttttgcagcttatgatttcaaagggaagaatttcttcttcgtattagtattgattattctttctattccttttgaagttatcatgcttcctttatacaaacagatgtcaacatggggactgatggacagctatgtagcagttgtactgccattccttgcacatgcgtcaacgattttcttcttcagacagtacctgcttggtacaccaaaatctctgattgaagcaggtcgtattgatggagcaactgaatacggaatcttcttccgtctgattgtaccgattttgaaaccggcattttccgctatggcaattttaaatggtatgaatgcatggaataactacatgtggccattactggttgtgcgttcttccagcaaatatacgttaacaatcggtttgaacacactgattaacccttatggagataactacagcctgttagtagtaggttctgtattctccattatcccaatctttattctgttcttatgcttccagagatacttcatcgaaggtatgactgccggagctgtaaaggaataaatacttaaaatatttacataattatgattttgaattttcaggaggattaaaaaatgagcagaagagcgaaaatggttctggataaagagttccagattgcaccaattgataagagaatttatggttcttttattgagcatttaggaagagctgtatatgagggaatctatcagccaggtcatccggcagcagatgaaaatggatttcgtaaagatgttatcgagttggtaaaagaactggatgttccgattattcgttacccgggcggaaattttgtatctaatttttactgggaagattctgtaggtcctgttgaggaaagaccacatagactggaacttgcatggagaagtcttgagaaaaatgaaattggtctgaatgaattttcaaaatgggcagaaaaagtgaattctgatgttatgatggcagtcaatcttggtacaaggggaatttcagatgcctgtaatcttctggaatactgcaatcatccatcaggaacaaaatacagtgatatgcgaattaagcacggagtaaaagacccacacaacattaaagtatggtgccttggaaatgaaatggatggtccatggcagattggacataaaacaatggaagaatatggacgtcttgcagcagaaaccgcaaaagcaatgcgcctgattgacccaagtatcgaactggtatcctgcggaagttctttccgtgacatgccgactttcccagactgggaagcaacgactctgtcccatacttatgagtatgtagattatgtttccatgcatcagtactatggaaacagagacgatgacagcaatgattatctggcacagtctgatgatatggatgatttcatccgtacggttatctcaacctgtgactatgtaaaagcgaaaaaacgtagtaaaaaagtgatgaacttaagctttgatgaatggaatgtatggttccattcaaatgcagctgatgatgatatcacagaaaatcatccatggcaggtagcaccgccaatgctggaagatatctacaactttgaagatgcactgttagtcggtttaatgctgattactcttatcaaacacgcagaccgtgtaaaaatggcgtgtctggcacagttagtcaatgtaatcgctccgattatgaccgatgcagcaggtggcgcatggaaacagaccatcttctatccatttatgcatgcttccaaatacggacgtggcgttgcactgcttccggttatgaacagcacaaaacatgcaactgcaaaacatgatgaaatcacagacgttgaatctgttgcagtttacaacgaagaaaaagatgaagtaacaatctttgcagtaaaccgtaacttagaagaagacgtagaacttacaacagatgtaagaagctttgaaggctaccgcatattagaacacatcgttatggaaaacgaagatctgaaagcaggcaacagcctggccggagaaaaagtttatcctgtaaatggcgatgagagaagcaaacttgacggcggagtgctgacaagcgtaatcaaaaaagcatcctggaatgtgattcgtctgggtaaataaaaaataaaagaagtaaatgaagaacgaattgtcgtattaatgtttgagaaaaatgttaatgcgatgattcgttttttgatttaaatgaaaaaaattatgaaacaaataactgtgatatacctacagaggcgagatgaattgttcaataattgggattgtgatataatgaaattgataaattagtgggagtttgtagtcagatacttttggaactgtgaatgaggcaaagtattagaaaattgaagattgtggagggtttattatgagtgagagagcagaaattacttttatgcagacaagattaatccgacttgcttcagaagaatggcatttaccgattgaacagattatttacttgttcaaaaaagtagatgttcttggatatatagaaaaaggttatgggattttccattgcgaaggtgatgaggcggtactggaagatattacggagcttcttgaaggaaaggggataaaagttaatgcttgaagtaaaagatggacttgttctctatcatggaagttattgtgaagtaaaagaaccagaccttgccaaatgtgcgaaaagaaaagattttggccggggattttatttaactacatccaaggaacaggcagaaaattttttaagaacttcaataaccaaggcaatagcaggcggaagaattgaagagggacagaattatggctatatttcgacttttgaagtaaaactttcgggaaaacttgagacacatatttttaaaaatgcggatgttgactggttacactgcgttgcagctcatagaaagaaaaaaatgttcatcgaagttgaacaggaaatgacaaaatatgatattattgcaggaaagattgcggatgatgcaacaaatgccaccctcacggcataccttgctggtgcttttggaatggcaggtgataaggaatcagatgatttctgtattaaacggttgttgccgaataaattaaaaaatcaatattgttttaaaacaaaagcagctattgagtgtttgaaatttgtggagagtgaaaagatatgtctgaagtaacaatatcaaaagaaaggataaactatacaatagaccttcttattactatggtaacggaagaaattgcagaagagacgggcagggatagaaaagaagtgctgatggattttctatgttccagaacaggaaaggcattatacgacgagaaaacaaagctttggtgcaatggaccatcgtatatagctgaagtgtatatggaggaattaaagcaaagagagattgataaatgagaagataaaaaacgaattgtcgtattaatgtttgagaaaagtgttaatgcgatgattcgttttttgttttaaatgaaataaataattgttgtatgaattaaggagagagacaaattgttctatcattgggattataacatgtaacgggaagaaagatggttattatttgccatcttttttctcgttctgataaaatttaggaggggtgactcgaaatggatcacaccctcctcttagttggaactatctattttccgacagacaatcatgagaaaatctcaccacaataaatgaaaactggatactagctatacgttatgtagtggtatacttaaggtgccgaataagatcggaaggggattggtgcttacaagcccgtccgacagactgattttcagctccttaggtgtaccactttttgtttccatcgggttttgatgaggacgcaggacagccaacaattaagcaaggagctgcatcggcttatgcgaaggaggtttgctttatggaagtattgtataagcggtgttgtgggattgacattcataaaaatatgatggtagcctgtatttttacgagtgtcagaaaaaaagaaatccgtcagttttcaacaatgacggaagatattctccaattagtttcgtggctgaaagaaacagattgtgagatggctgccatggaaagtacgggctcttattggaaacctgtatataacatattcgaagaagaacagataccgatcatggttgtgaatgcgcagcatatcaaaggagttcccggacgtaagacggatgtaaaagatgcagagtggattgccgatctggtacgccatggattagtaaaggcaagttacataccaaatagggattaaagagaactgcgagaaataacccgttaccgccaggaggtaattgaagaacgtgctcgtgaattaaatcgaatccaagctgtgttagaaggctgcaatattaaactgagcagtgtaattaccgatatcagcggaaaaagcggtatggcaattttaaaggcaattgtatctggagaaacagatccggttgttttaagtgaacttgccgaaggaagagccagagataaaattccagaaatgcagaaatccctacaaggacggatatcagaacatcaacaaaaaatgttgaaacatcaactggggcatattgaaagcctgaccgctttaattgtggatttagatgcagatattaaaaaaaaacagaatccataaactgggcaatcgaagctttggatgatatgcctgggattggaagaaaaagtgcagaacgaattttagcggaaactggtgtggaaatggagcactttcaaaatgaatcccgtttcagctcatgggcgggacttgtgcctgagtgtaaggaaagcgccggaaaaaagatgagtacacgaatacggaaaggaaataaatatttgaaagcaacgctggtggaatgtgctcgtgctggaatacgaaacaagcaaagttatctctactcccgttatcaaagaattgccgcgcgcagaggtgggaaaagggctttgattgcagtagcccataccatgttaatcgcgatctatcatatactaaaagagaaagttccttatcatgaccttggagcggattactactccgttatcaatcaagaaaagataatcaataggaatattcgtacattagaaaagttaggggtaaatgtaatgattcagccgaaatgaatctctttaactgtataattaagagaaggaaataagcccgccaaaaggcgagcttatttagaatgcttgtttatagattatcgctgaactacgttttcaggacagccacttttttgtgaattgtagaaattagaaaagattaatgaggacattttgtatatgtataagttgaaatcaaatttcctaatactaaattctggcaggaagaacatctttgcgcttgatattttagaaccttgcaactgccgttggtctttttatcatgtctggtataagttccacttacataggtatgcttacataattttttttctgatatggctacatctggtatggccacattataagaagttccattttcatctgtgaaataagaattagaaaaaagaaaagtatcctcctctttatcaacaactgagaagaagccttccgttccagatatatttttatctttattaagaacttcttctaaggagtgaatattatctatttctacagcgggtgtattataagcaagaatggtaagggaagaagaaatacttaagaatataattccgaatccagttacaatagaagtaaaaatagggtgcttatgtacagtatgttttttcaaatgagtaatcctctctttcagtgtattttttcgatgaaacgtaaatccacttgaagaaacaagtgaaagatgcggtggtgtagatgaatattttaaaaggaccttgccatagtttcttttttgttcgagtgtacaattcattaacgctaaatcatcagcggctaattctgaagtattttgataaaattgaattaaaagataaatacatgggttataccaaaacaaaacagataaaagcataagagttagcttaaataaattatcatggtgttttagatgtgcaagttcatgtttaataatcaaatggtttgtatcatcagacaaattaaaagataaaggtaaaaatagtttcgtgttcaaaaatcctgtcacaaaaggaattgaaatgtggtcggataatgagagaattggagatttagataatctcaaatccctcgataagtttgtaatgatagcttggtttggctgaatgaattctttaaaattaaaatcggaagcaatagttgagcagaaacttttagtttgaagatataatcggcgtatgtaaatagctctaaacagcataatgctaatgcataaaaacagtccgattaaaattccaatactgatattcggtggacgaagaaccagatgattttgaacaattctgattgaatcatcaacaggtattttatctgttggttttggatgcatcataaatggagaaaacaatcgtttgtaataatttgtaagtaaaggaacaggaagtaaaaataagaagatatttactttacaaaataaaagtttatgcttgggcgcaagctgtttattaaataaatgcgttgcgccaatagataaaaataaaaagacacttccgataagattcatataaaaaagtaagcgaatggaagaagcaattattaaatttatcataaaaaaatcacatcctaatctttattgagaaaatctcttagttcatccagctcttcttgtgtacaatcttttttgttgcctgtaagggcagaaagaaacaagttcaaagaaccattaaatgcattgtttaaaaaagattttgcatatctttgagtgagctgttcacgtgtcaattttggaaaataagcttttttacgtccttcatttttacagtctaatgcacccttttcaattagacgtgaaagatgagtgtgtaatgtttgctttttccagtcttttccattgttattaaagaaatccaaaatttgattgaaataaatggggcatttagaagaccatatcatttccatgatttccaattctgtgtcagataaaccgtatcgatttggcataaaaacctccttatgaatgtagtactattttaaaatagtactataaaaatgtggggaggtcaagaagaaataataaacaaataattaataaataattaataaataattaataaaagtattgacgaatactatatttatatagtacaattgtattataaagatataggacgtagcttgagcaatggtgaaaatgtaaagtagagtattatcaaagtaaaaaggaatgtgtagtataaaaatctaatatttactagtaagttttagctaatagaagactttgtctttgtaacagtttattggcataataatattataaattttcagaatattattagagttgctggctttttttaaaaaaatgaaggcttaagagacaaaggcaaactcaggaaagtaatagttcgtgattgaaaaaatgaaaggaatgaaaaaatgaagaagataataaataaagttattgtgttcacattgatttttaatatcagtattattattaatgctatatctattcgagcagcaggtgatgatgataaaaaagtatatacggaattagatgaaaatgtgaggaacatacaagatagtaaagatgcctgtattggtgtggagggcgaaacagagccaaatgaaatgattgagtatagtagagcaactacaaaaccaggtaaatggattaaggcatctgatggacgttggtggtataagcataacgatggaacttatactaaaaatggatgggaatatatagatggaaaatggtactattttgatagtaacggttggatgaagacaggatggattaaagtaaataataagtggtattatttaaatagtagtggagcaatggttgtaggatggcaaaagataggaagtacatggtattattttaattcctcgggagttatgcaaactgggtggaaaaaaataaataatagatggtattttttagaatctaatggagcaatgagaacagcagctttaacacagggcggttcaaactatacatttcagagttcgggagcattaaatacaactaggctgggagttcaaaggcaaaggcaggaacgaactaattggtgctgggcagcttcttgtgttatggtcggaagatatgatttgccggcatcattacaaacaataacacaaacatcagttgttttacatgtaaaaggagaaattattaatcttgcaggaaatggctcagaagaagtgagaggaataaatcatgcttctcaaagtttaaagcatgcaacatctttagaaagaactctctcttttactgaggtacttaatactattgataatagacatccgtttattgtaagaatgagatgggatggtggcggtggtcatgcagttgtatgtgctggttatagatattctgattcttcattataccttatagatccgtgggaaaatacagcgtcgaggtattattcacgtaatagtctggtaagaggtacttctattgctactggtacaggtcaatatagattttcggtaatatattaaaaggatgataagaaagaagggcgtagttatgaaaaaatttttgataatagcagtatttactttctcaattatatttttaaattcctctaatacatacgcttactcaatcgaaacactagacagtaatccagatttacacgaaatttcccaaatggaagacgagatttaccgttgggcgcaaggcgcagtagaagatgaaaatacgaatttacaaatcgattattctcgagcagtgaaaatatatatagatacaaatatttttgaacaagaagaactgacggctgaaaatttacaagatactttagataatgcggtttatatttgggaagttcctgtaaaagtttcagaagacagatatgtgattgtaactgtaagcagggcactgccaattgatgaagaattgcagcaggagcttcttgaagatggcacttatacacaggaagaactggaaatggaacttgaaaaagtaggtagttggacaattccaacagccggatatgatgaaacaaaatcagactatattggaaagttagattctgttttgggagaaactcttaataaagaggatttagatatgatataccttcttggtggaactccgaagatgagacagccttttggtgttgtttgtagagaaggcaaatatcagattgttacattagatgtggtaaccggagaaaatgatataagtgcttttagttcagaagaaagtcaggaactgaatgagaatagtatttatagttttgaacaggtgaaagaagtaatagagtcaatgccagaagtggatgacgaatcagatacagggctagctccaacattaaaaaaagaaaatatgaaaaaagaaaatgctaaaaaggaaaggatatatggtgttgtagttttactggtaacagttttgctggttggcgtagctttgggtaaaaaattgaaacggaaaaaataaatttagagaaagaaggggtgtcgggaaatatctatttcccgacacccctttctttttctaagttagtcaagcggatattcgtattttgattcgctacttccttgattcggttaaattattaattacatcggaagagccatatccccatctttaatccagcctaaatttctcatcatatttgagaagaaataggtcagtgcagccggaagagcaaagtgcataattaaaattttaaataataccactacgcttgaaactcccggaacagccatggtctgccaggtcataatctgtccgacaagtcctgctgttcccattccggaaccggttgcattgtttgtcattttaaagagaagtgtagaaaccggtcctaagatggcactcgataaaatgacaggaagccagatgagtggtttcctcataatattaggaacttgaagcatggaagttccaagcccctgtgcgatcagaccaggagctccattttctttataacttgcaattccaaaaccgaccatgttacaacagcatccgacggttgctgcaccggcggcaagcccggatagatttagaataattccaagggctgcggaactaatcggaagagttaaaatcatacccattaaaacagagacgataacgcccattaagagaggctgttgttcggttccccagttaattaattctcctaattcagtcattaacttgctgattggaggaccaaagaaaagaccgatagccgaaccggttaaaattccggttaaaggggtaataataatgtcaagttgggttttgccggagacaacatgagcaacttcaattgcaatataagcagcaagaaaagcgccaagcggttctccgggaccggaaagtaacagtgcaccatcctccgtgaaaatcgttccggcaaggattttgcttgaataaccgccaaccataccggcagttgcagaagagagtacaaccagaggactttcgccaaatttgcaggcaacaccgatgccgataccggcgctggtcataccggcagctattttaccaaactgatagaggtaagtgccaatttcaccactgattaaagtaccaatctgttgaagaattgttccgataataagagtggcgaacagaccgtaagacataccggtgagtccatcgataaaaaatcggtttaatattttttttaccatgatatctcctgtattctattttacttaatctaatttaatatttttaaaaagagagccgagtgttgtagtagcttcttctgcttccggaagttcatagtcgatgacttcttcctcttcttcttccggagcttctattaaagctttcatgctgagactcagttttccatcttcatttttgataacttttacggttacgttatcgccaacagagaggactgcttttggagatttgattcgtttctggctgatctgtgagatgtgaaccagaccggaaatgccatctccgaggtcaataaatgcaccgtaagtctgaaggctttctacggtaccttctaatacgcttccaacagtaatctgctgtgtttttgcaagtttttcggcgtcagcctgctcttttaataattctcttgcggaaaggacaagacggttttctgcttcatccacttcaaatacacgtaccatcaaagttttctttaaaaattcttccggttctttgacatattccagagaaagtttggaaaccggaataaaggcacggatgccttccacgtaagcgattgctccgccttttacgatgccttcaatagtaacttcaaatgcttctttatcttctttcatctgttctaacttgtcccagatttccatgtctgcgtcacggaaattgctgaaagaagcttcgatttcctgtgcaaaatcatccattgtttcctgtttttttatttcttcgctcatgatgctacctccattaatacttccttaaataaaattgaaaaataggaagctttttgttttcgattatagcacaggaaagtgaaaatctgcaatggagtagagagaatgttgaaagatttgttgattttgtcgggtgggttaaggtaagataagaaagactaaaaaccgatgtagatagttctgacaaaaagccagaatagaaagagagaaagaccgatggaaatcagaaaagcaaaaatagaagaactcgatgaaattatggaaatttttgaacatgcacgtcagtttatggcgaagaacggaaatgcgtcccagtggggaacaacttatccggaacaggaaatcgtagaagcagatatcaaaaaagaagagtgttatgtgtgtgtcgaaaatggtgaaatcgaggcaacgtttgtattttttatgggaaaagtagaaccaaattatgtggatatttatgacggagagtggaaaaatgaagctccttatggtacaatccaccgcgtagcaagtcgcggaagagttccgggaatctcaaaaatctgtatggatttctgcaaatcacagatttcgaatctgcgtggagatacttataaggataatattgtaatgcagaaagtatttgccaaaaatggatttgaaaaatgcggtacgatttatcttgctggaaaaaaagaagatggaaacgcacgaattgcctatcagtttgtgggtaaataattgcacgcagaagaaaaatgggatattatatagagtagaagaaaaatttgaaatagaaaagaatttggaatgtaaatataagaaagggaagcacacaacatggcgaaacaagaaaaaatctatattttaggacataaaaatccagataccgattcgatttgttcagcgattgcttatgcagatattaaaaatcgttcgaatgatggaagaaagtatattgcaaaacgtgcaggtcagataaatgaagaaacagagtatgttttaaaacgttttggcgttgatgcaccaggctatcttccggatgtcggaactcaggtaagagatatggaaattagggaaactccgggagttccgcacagcatttccattaaggatgcatgggcgattatgaaagaaaccaatgcggtgacacttcctattacaaaagaggacggacagttagagggactgattacaaccggagatattgcaaaatcttatatggatgcgcatgataattatttcctttccaatgcgagaacccagtatcgaagtattgcgaatacagtagaaggaaagattgtaaccggaaacggacatggatatttcttaagaggaaaagttgtaatcggtgcgacacttccggaaaaactgggagagtacttagaagaagatgatttggttatcttaggagatagatacgaagaccatttatgtgcgattgaagaaaatgtaagctgtattattgtgtgtaacaatgcggaagttgcagaggatattcaggaagcagcaacgaaaaatgactgtgtaattatccgttctccgcttgatacctttacgattgcgcgtctgattaatcagagtattccggtcaaacacatcatgaaaaaagataatctgattaccttccagaccgatgattttacagaccagattaaagaggtgatggtaaagaaccgtcacagagccttccctgtagtaaataaacatggaaaatatattggaacggtttccagacgaaatttgctgggaatgaagaaaaaagaagtgattttagtagaccataatgaacgttcccaggcagttgataatattgaggcagcggagattctggaaattattgaccatcacagaatcggctctatcgaaaccatgtctccgattgtctttcgtaatcagccggtgggctgtactgcgacgattatgcatcagatgtatgtggaacgaaatctcgaagtttctccggcaatcgcaggacttttatgcgcagcgattatttccgatacgctgatgtttcgttcgccgacctgtacacacagagataagatggcagcaggagcacttgctttagtagccggtattaacatagaagaatttgccaaagaaatgtttacggcaggaagcaatttaaagggaaagacaacagagggaatcttctatcaggatttcaaacgttttacaaccgaacaggtaaactttggcgtaggacaaatcagttctatgaatcaggatgaactgttaagcttaaagaaacgtctgattccatttatgaaaaaagaatgtggaaaaaatggaattacgatggtatttattatgcttacgaatattttggaggaaacatcagaaattatctgttatggagatggaagtggcagattggttgaggatgcctttaatgtaaaagaagaaaatggcggatatattcttccgggagtcgtatcaagaaagaagcagttaattccggaatttatcactgccttacagcagaatagctaaaagagaaaatctcgaagaaatgaaaaacagaagaaggggaaacacatgggaaaaattgaatggaagcctggaaacatgctttatcctctgccggttgtaatggtcacggtggcagatgaagcagggaatgataacattatcacggtagcatgggcgggaacggtctgcaccaaccctcctatggtatcaatttcggtaagaccggagcggtattcttatacaatgctatgtgacacaaaggaatttgtcatcaatctgacaaccgaaaaactggttcgcgcaacggactattgtggtgtaaaatcaggaagagaggtagataaatttaaagaaacaggactcaccagagaaaaagcatctcatgtgggtgttccgatgattaaggaatctccggtctgcattgaatgcagggtcagggaaatcaaagaactgggaagccacagcacatttgttgccgatgtgcttgcagtccatgtagatgataaatatatggatgaaaaaggaaaatttgatttagcacttgccaatccgattgtatattctcatggggaatattatggactgggcaaaaaactgggaacttttggatacagcataagaaaacagagaaagaagagacagaagaaatgagtaaagaaaatatcgttttaattggcatgcctggagttggcaaaagtacagtaggtgttattttggcaaaagtattgggatatcagtttattgatgcggatttagtaattcagaaaagagaaaaccgcctgttgcatgaaattatttcagaagaaggtttggatggctttttaaaagcagaagaaaatgcaaatgtatacattgcgcaaaatgaagaaaaatcgattgttgcgacaggtggaagtgttgtgtattgtgaaaaagcgatgcaggagttgaaaaaaacaggacgagttatatacttggagttggaatatgaccagctgaaaaagagactgggaaatttaaaaggtcgtggtgtggtattaaaagatggtcaggatttaagagggttatatgaagaaagaattccgctgtatgagaaatatgcggatttgacagttaatgaaaaaaatctggatgtagaacagactttacagaaaatagttgacagactttcattataactgacaaaatgaggaattgcaagcagtaaatctaggcaaaagacgattttttgtttacaaacccggtaagatgttataagataagggttgactattatgaaactttgaaaatcaggttatgaatttgatgataagaatgacaaaaacaggcatcagatacatgaataaaaatatagaggtgtgtatatggaacaatatgtaatcaaaggcggtaacccgctcgttggtgaagttgaaatcggtggagcaaaaaatgcagcacttgcgattctggcagcggcaattatgacagatgaaatggtttatattgaaaaccttccggatgtaagagatatcaatgtattactcgaagcaattaaagaaatcggagcagttgtagaaagagtcagtccgacagaagtaaaaatcacaggttctactatttctgatatcagtgttgagtatgaatacatcaagaaaatcagagcatcttattacttattaggagcactgctcggaaaatataaatccgcagaagttccacttccgggcggatgtaatatcggaagtcgtccgattgaccagcatttaaaaggattccgtgcactgggtgcatccgtagatattcttcacggtgcagtcgttgcaaaagcagagaacttgacaggaaaacatattttcctggatatggtatctgtaggtgctacaatcaatatcatgatggcagctgcaatggcaaccggaaataccattattgaaaatgcagcaagagagccgcatgttgtcgatgtggcaaacttcttaaacagcatgggagcaagtatcaagggtgcaggtaccgatgtaatccgtattcagggtgtagaaaagttacatggaacaacttattccattattccggatcagattgaagccggaacatttatgtgcgcagccgcagcgaccagaggcgatattatggtaaaaaatgtaattccgaaacatctggaagcaacaactgcaaaattagaagaaatcggatgtcaggtagaagaatttgatgatgcggtgcgtgtagtggcaaacaaacgtctgactcgtactcatgtaaagactatgccatatccgggttatccaaccgatatgcagcctcagtttgcagtcgcacttactttggcagaaggaacaagtattgtaacagaatctatctttgaaaatcgttttaaatatgcggacgagctttctcgtatgggtgccaatatcaaagtagaaggaaatacagcaatcattgatggcgtggaaaaactgacaggcgcaagagtcagcgcaccagaccttcgtgcaggtgcagcacttgtaattgccggtcttgcggcagaaggattcacagtcgtagatgatattgtttatatccagagaggatatgagcgatttgaagataaattaagaagccttggtgctgagattgaacgagtatccagtgaaaaggaaattcagaaatttcagcttagaatcggctgaaaaccagtaaaatagcattaaaaataaaaaaaacggtttggaataaaatccaaatcgttttttccttgacaatgtttagcacctgtgctatggtaagtgcgtgtatagatttcatatcaacttattaagtgcatcacagacattttcccctctttttttgtccgtggtgaaaagggaatcaggtgaaaatcctgagcggtccggccactgtaagcaaggagcgaagcgcaagaatccattgtattagagcgtacgagaaggagcgccaagcgttgataggcaagtcaggaaacctgcttaagtaagtgaaaggttgaaacttccgaagaaagttttccatccatgatatctgatatggaacgccttatgcttgaaaaagcacgtatcagaagaacggtacattctgatacaaacttagaggaacctgtgtacggaatttatacatcctttactttgaaagggcaggagaattccaaaagctgtattcgtacataaaacctccgcaaaaaatatgtatgattggtcaatacaggtggaggaattcctcctgcaaaaagttaaaatggacaataaaaacaaagctgttatagataatagtatcttatctgtaacggctttttttggtataatagaaaaagttagtaaaggtatttgaaaggggaaatttaagatgaaaaaaatagaaatggaaaaacaggcaaaagcatttggatttgcaacaatgaaatttatggaaacaaaagatctggagtttgaacatgaatttcgacagttttgtgagatgaatgactgtgggaattatggaaataattatgcctgtccaccgctttgcggaacaccggaggaaatggagcaaaaggtaagaaaatacgaacatgcgttggtttttcagtcaagaactccggttcaaaatatttttgatgatgcagaaacaaaaattattaagaagatgcatacaaataaaacattacatgccgtagaagaattgaaagagcagggtctgcctgataatggaatgtttattatgtgcggaccatgtaatttctgtgaggaatgtaaagcaaaagcaaaagaaccatgtgtcaatgaaacgatgcgtttttcgtgtctttctgcttactgcattgatgcaggaaagatggcaaagcattgtaatatgaatatggaatggaacggagatgtggtttcgttttttagtctatatgttttttaagagaataggacagggtgtatgagacaagagcttaatttaacgcagacgcagaaactatcagaaaagatgattcagtcacatccgctcagtgaccagaaaattgcagagaagatgcaggaaaaaggaatcagcatttcaagaagaacggttgcgaaatatcggggtcagatgggaatcgcagatgccggaggtagaaaagtgtatttgtaagaaaatataaggagatattttagtaaaaataaggaaaatcggaaaaataccttgcttttttaaaaataacgtgtataatacaccatgaaactataaaaaaatcaaatagtggttatcccttttattcagagtgatggaggtacataggacctgtgaagtcacggcaaccccttgaaaaaggaaggtgccagcctgagcgagtaagtcgaacaataagaggattcatttaaaaacttatgggtccgcttgtctgcggacctttttacttgcatgtaaatgggaataagaaacaaaaaatcaaacaaaggagaacaagaagaatggaaaaaagattatttacttccgagtccgtaacagaaggacatccagacaagatgtgtgatgcgatttccgatgcaattctggatgcattaatggaacaagacccaatgagccgtgttgcatgcgaaacatgcacaacaaccggtgttgttatggttatgggtgaaattacaacaaaagcttatgtagatattccgaaaatcgtaagagaaacggttcgtgaaatcggatatacaagagcaaaatatggttttgatgcagatacctgcggtgttatcacaacaattgatgagcagtctgctgatattgcgatgggtgttgataaagcgctggaagcaaaagaaaacaccatgtctgatgaagaaatcgatgcaatcggtgctggtgaccagggtatgatgttcggttttgcaagtgatgaaacagaagaatatatgccatatccaattgctctggctcacaaactgtctcgtcagcttacaaaagttcgtaaagatggaactttaacttatttaagaccggatggaaaaacacaggttactgtagaatatgatgaaaatgacaagccaatgcgtctcgatgcggttgtattatctacacagcatgacccggaagtaacacaggaacagattcatgaagatatcaaaaaatatgtatttgacccgattcttccggcagaaatggtagatgaaaatacaaaattcttcatcaacccgacaggacgtttcgtaatcggtggacctcacggagacagtggtttgacaggacgtaagattatcgtagatacttacggtggatatgctcgtcacggcggtggagctttctccggaaaagactgtacaaaagtagaccgttctgcagcttatgcagcacgttacgttgcaaaaaatatggtagcagcaggtcttgcaaagaaatgtgaaattcagctttcttatgcgatcggtgttgcacatccaacttctatccaggttgacacttttggaacaggaaaactttccgaccagagactgacagaaatcgttcgtgaaaacttcgacttaagaccggcaggaattatcaaaatgcttaacttacgtcgtccgatttacaaacagacagccgcttacggacatttcggaagaaatgacttaaatctgccatgggaagcactggataaagtagaagaactgaaaaaatatctggaagattaataaaagaaatttctaagattcactaaaaaaagtggagaatagataagaataacagggagttttttgtagaaatatgaaaaatttcctgtttttttgtgatataatatgatgtaagtgtcaaaagtataaattgcggttgtgcttgcacaaaaagcaatttatagaaagtttagacttgttttattaatattttcaagaaagagaagaggtttatgttataattatcgttataaaaattttatcttaagttttggaatgggataaacactaaaaaaacaggcaggaaaggagaaaaaggagcaatgaaacttaaaacaagaatcgttatctccttttttgttattatcctcgaaccgctaatctgcgcaagtgttgcattttgggcattcagccagcatcagttaaatgtgatggaagaacaatatggaattgaaaatgcctcttatgattcactttctaatacggcagaagtgattaacagcatgaccgatgacattgcagaagagctgagggagacggcaaaaaaagatacgaaagaattagagaatgaagattatttaaatcgaatcaatggcagattaaaggaagtacattcctatctcttagtaagagaaggaaaccaaattatctattatggaaatgaaaattattcaagtgaacttgtgaaacggctgcctccttatgcctcaattgaagatgagaactccgaagaagccattgatgcacaggataatgatggactttatctgggaggaacagtacaggcactggtgaaacagattaattttgaaaaaccagatggaacacagggcagtgtctttattgtgtcaagtattttaaaaactctgccgcagttaaaggcactgataaaaaatatgatgatttctgtagtggtgattttgattcttaccggtcttggactgacctggtggatttaccgtggagtcattgcaccgcttgataaactgcgtacagcgacacagaagattaaagatggagaccttgatttttcgattacaccggaaggtgtgagtgaaatttcggacttgtgtcaggattttgaagaaatgcgtcagcgtttaaaagagacatccgaagagaaagttcagttcgataaagaaagcaaagagttaatcagcaacatttcccatgatctgaagacgccgattacagcaattaaaggctatgtggagggaatcatggatggtgttgccaatacaccggaaaaaatggataaatatatccatacgatttataataaggcaaacgatatggatcgtctgattaatcagcttacattttatacaaagatggacactaaccgaattccatatacatttaacaagatttccgtaaccgaattttttaatgactgtgcagaagaaattggaatggaacttgaatcaaaaggggtagagtttaactattcaaactatgtaggaccagaggtgctagttattgcggatgcagaacagattaagcgagtgattaataatattaccagcaattctttgaaatatatggacagcaccagagcacgccgaattaatttaagagtaaaagatgtcggagattttattcaggtagaaatcgaagataacggaaaaggaatctcagcaaaagatttaccaaatatctttgaacggttctaccgaacagatgcgtcaagaaattcttctaaaggcggaagtggaatcggtctttcaattgtaaagaaaattatggaggatcatggaggaaaagtctgggcaaccagcaaggaaaatattggtacagtcatgtactttgttttaagaaaataccaggaggtttatcagtaaatgagtaaaattttaattattgaagatgaagaggcaattgctgatttagagaaggattatctggagttgagcggatttgaagtggaaatcgaaaaccgcggagatgtcggattaaaaaaggcattagagggagagtatgatttatttatccttgatttaatgcttccggaagtagatggatttgaaatctgccgtgaaatccgaaatgtgaaaaacacaccgattatcatggtttctgcaaagaaagatgatattgataaaatccgtggtcttggacttggtgcagatgattatatgacaaaaccgtttagcccgagtgagctggttgcaagggtaaaagcccatctggctcgttatgaacgcctgattggaaccggggtacaggaaaatgatatcatcgagatccgcggcttaaagattgataagacagcaagacgtgtctggattaatggagaagagaagaattttacaaccaaagaatttgatttattaaccttccttgcacagaatccaaaccgtgtctttacaaaagacgaactctttaaagaaatctgggcgatggaatccattggtgatattgcgacagtaaccgtacacattaaaaagattcgtgaaaagattgaattaaatacagcaaaaccacagtatattgagacaatctggggtgttggatatcgtttcaaagtctgaaaaaatatacttgacaaatacgcaagaatatcgtacagtaaagtggtaaaaacaaggggagcttatttgataggctgagaggaagttaagaacttcgacccataacctgatttggataatgccaacgtagggacagacgtatgaaatgttgcgggagatgtcagaagttggcacctcccgttttttatgtatcctcataatcaagcacagaaagattctgagtgtacgatgtttttaattatttgacaattgaataagtaataccaagtgattgaatgagagttcatgaaggggtgcaccaccgcgggtgtatttctttcgtgaactcttttttatttcattaaaaagttttgtcatgaaaaataaaaaacatgttctacaaaatgccaaacaggaaaattaagaaagtacatcaagaaagtgaggagtttagaatgattaaagtaaatggaagagagcgagattttgttccgaataccaccattgcacagctcttagagcagatgggttacaacctgactcgtgtagcggtagagtgtaatggaaagattgttccaaagaagcatttagctgaaacattaacaacagatggagacgtcttagaagttgtaagttttgtaggaggaggctgagatgttaacaaaagaagaaatcagggaggcgcttgttgagcgtcattcggaggaagttcaaagtaaattagatgaggcaaaagtggcgattgcaggacttggcggacttggctcaaatattgcattttttcttaccagaatcggtatcggacatctgcatctgattgattttgatagagtagatattacgaatttaaaccgtcagcagtatcgcatggaacatattggcagatacaagacggaagcacttttggaggaacttcgggaaatcaatccataccttgaggtagagacagactgtgtgagagtgacggatgaaaatgtagggactttatttcacaatgaagacattatctgcgaagcattcgaccgtccggaagcaaaagcaatgttagtcagcggagtaggagaatattatccggataagattttagtcaccggatccggcatggcaggctatggaagaagcaacgagattgtgacaagaaaaatcaatgagcatttttatttatgtggggatgcgcataccgaaccggtaaagggaagagggcttatggcaccgagagttgcaatctgtgcagcacatcaggcaaatctgattacagaactgattatcagaggcaaatagagaagagaaaaagaaagttaaaaagaaaataaaataagaaaaaataggatatagaaaaccagatggaggaaaacaaaatgaataatgatacatttacacttgggggacatacatttgagtctcgttttattttaggttcaggaaaatattctctggatttaattaaagcagcagtggaaaaagcaggagcacagattattacattggcactgagacgtgcaaatgagggaggaatggcaaatatcttagactacattcctgaaaatgtcacactgcttccaaatacatcgggtgcaagaaatgcagaagaagcagtgcgtattgcaagactttccagagaactcggatgtggagattttgtaaaaatcgaagtcatccatgattccaaatatctgtttccggataactatgaaaccatcaaggcaacggaaattctggcaaaagagggatttgtcgttatgccatatatgtatccggatttaaatgtggcaagagaacttcgggatgccggtgcagcgtgtgtaatgcctcttggttctccgattggttcaaataaaggaatttgcacaaaagaatttattcagattttaattgatgaaattgatttaccgattattgtagatgcaggaatcggtaaaccatctcaggcatgtgaggcaatggaaatgggggcagcagcagttatggcaaatactgcaattgcaacagcaggtgacattccggcgatggcagaggcatttaagcaagcaattgaagcaggaagagccgcttatctggcaggtatgggacgtgtcatggaaaaaggagcaagtgcatcttctccgcttaccggatttttacaggattaagagcggggggagaaaaaagatgagtacagaaaaccatgtaaatgagagtattttaaatgatgaaattaaagagtggcagaagaaaaaccgtatcgaccacatgacttatttaaaaggaatggaagtgcttgagtccgatgtgcagaaacaggtcattgatgccatgaatgagtatgactatgagaaatataccgcaaaggatgtagaacgtgcccttgcgcatgagagccgtactccggaagattttgcggcactgttatcaccggcagcactgccgtatttagagcagatggcacaggctgcaaaggcagaaaaagaaaaacactttggaaatggtgtcaatatgtttacaccgatttatattgcaaattactgtgaaaatttttgtatttattgtggatttaactgccataataaaattaaccgcgcaaaattaaatgcacaggaaatcgagaaagagatggcagcagttgccaaaacaggacttcaggaagttttgattttgactggagaaagtcgaaaatattcggatgtgaaatacataggagaagcctgtaaaatcgcaagaaaatattttaaagtaatcggtcttgaggtttatccgatgaattctgatgagtatgcttatctgcatgaatgtggcgcagactatgtaaccgtattccaggaatcctataattcggataagtacgaaacgctgcatcttgcaggtcataaacgaattttcccataccgcttaaatgcgcaggaacgtgccttaaaaggtggaatgagaggtgttggattcgccgctttgcttggtctggatgatttcagaaaagatgcgtttgcaacaggtatgcatgcatatctgctccagagaaaatatccacacgcagaaattgcattttcctgtccgagactgcgtccgattatcaataatgacaagattaatccgatggatgtccatgaaccacagctgcttcaggtagtatgtgcttaccgcctgtttatgccattttcgagtattacggtatcaaccagagagtgctcccgtgtgagggataatctggtcaatattgcagcaacaaagatttcagcaggagtcagcacgggaatcggagaacacgtagaagagattgagaataaaggagatgaccagtttgaaatctcggatggaagaagtgtggaagaagtctatgaggcacttcttgatgaaggacttcagccggttatgaatgactatgtttatgtataaagaacaggtaatagcagttacgaatcgaaaactctgtcgagacagagaagcgtttttatggcagataaaaagaatctgcaagaatcagcctcatgctgtgattctgcgtgaaaaagacctttcagaaagtgaatatacagcacttttgttttcggtaaaaaagatttgcgaggagcataaggtaagttgtattgcacatacttatacggaatcggcacttgaagtcggatgcacgaaaattcatgttccgcttgctgttttagaagcaaaccctgagattgcacagaagtttgaagtgacgggagtttctacacacagcaaagaagatgcaaaaaaagcgcaaaagctgggtgcttcttatgtgacagccggacatatatttgcgacaacctgtaaaccgggacttgaaccgagaggaacggcatttttaaaagaagtgtgcgatgaggtggaaatcccggtgtttgcaatcgggggcatgaaaacaacgagggaatgtgtggaggaaatgcgaaaactgggcgcttcaggaatttgtgtcatgtctgagtgtatgaaatggatctgactgcgtaaaagaaatttcagcttgcaagaacgtacaaaatatgctaagattccatcgaaagcagtattatttgaaataagaaaagcgatgaagagaaatagtagatattagtcctatgtacagagagaagccggttggtggaaggctttgataagatggtatcgaaccggtcttggagctgcaggttgaaattgagccggaaatttatcaggcataagaaagtagacactgtcggaagtcccccgttaaaaggaaatgatatcgaggaaactctgtatctatgagtgtgggagtaatcctgaattcaggtggtaacacggatgaatattcgccctgaactgattgaagaaatttgtcagttcagggttttttatttcattaattaatttcattttttgttgagtttaaagattttttaggaggaagtaaatatgaagttaagtaaacttgtaggagacagatttaaagaaagaccgtctgactgtgttatcgacagtcatgcactgatggtaagaggtggttacatgaagtatgtggcaaacggaatttattcccagtatatgccgcttcgtcgtgtatgccagaaaattgaagcaattatccgtgacgagatggataaaatcgatggacaggaagtacagtttccggttgccctgccggcatctttatgggaagaatccggaagatatgaaagcgttggaagtgaactgcttcgtttcaaagacagaaacggaagcaaaatggtacttggtatgacccatgaagaggcagcggttcagttagtaagagaatatggacagacttacgcaaaatatccatttatgatttatcagttccagacaaaattccgtgatgaagcacgtccaagagccggtctgatccgtgtacgtgaatttactatgaaagatgcgtattctttccacacatctcaggaagatttggaagaatattatgacaaatgttatcatgcttatgaaagaatttttgcaagagccggaattccggaaacaatcgcagttgcatctgactctggtatgatgggtggaagcctttctcatgaatttatgcttttgactccggttggagaagattccattgcagtatgcccggaatgtggttacaaagcaaatgtagaggcagcagaaaacattgtagaaaatgaagctgaagaatatcaggaattaaaactggtgagcactccaaatatgcatacaatcgaagaagtatgtgaattcttaaacagctcagcagaaaaatcctgtaaagcggtagtatatcagaaaaattccaatgatgaatacgttgtattatttatcagaggggacttggaagcaaatgaaacaaaactgacaaacttcttaaaagaagaaattcatccggcagaaattaccttagaaagtggattacatccaggatttatcggaccttacaagatggatgcaaatgtaactgttttatatgacagttctttaaaaggtggatgcaatctttgctgtggcggaaatcaggatgattatcattacacagggctttgtatggaaagagatcttccggatgcagaatatcatgattttgcaaaaatcgtagatggcggaatctgcccatgttgtaagaaaaaagcaatcaaagtatcaagaggtatcgaagtcggaaacattttccagctcggaacaaaatatacgaagagcatgggaatgaaatatctcgataaagacagcaaagaaaaatatccgattatgggatgttatggaattggtgtcggcagacttgctgcatctgtctgcgaagcacatcatgatgagtatggtccaatctggccaatgacaattgctccatggcaggttcacctttgctgtgtacgtccggacaatgaagaaatcaagaactattcagatggtttatatgaacagttacagaacgcaggaatcgaagtactttacgatgacagaaaagtaagtgccggtgttatgttcagcgatgctgacttaatgggtattccggttcgtatcattgcaagcccaagaaatatgaaagagggatgctgtgaagtggtaacaagagataaatctgtaagagaaaaagtagcattagaggatgtatttgcaactgttcagaaaatggtacaggaagcacttgcaagataagttaaccgaatgaaagagtgaagtggattgtgaatatccaccggacaaatataagaaattaaaaaaatgaaaaaatatatcgatgaagcattatatgaatacagcaaaggagaggtttatccatttcacatgccggggcataagcgcagcttctgccctgagacattaaaaaatccttatgaaattgatattaccgagattaccggatttgataatctgcatcatgcggagggaattctcttagaagcacagaaacgtgttgcaaagttgtaccatgcagataaaagcttttatctgataaatggaagtaccgccgggcttttaagtgcaatttcagcatgtaccagtgatgggggcagtattttgatggcaagaaactgtcataaagctgcctatcatgcagtttatttaagacgtctgcatgcacattatttatatccggctgtgtttgaagagacagaattaaatggcggaattacaccgaaagcggtagaagaagctttgaacgtctgtcctgagatagaagcagtactgattacttcgccatcttatgacggaatggtgtctgatattgctgaaattagtgagattgtacacgcacatcaaattccactgattgtagatgaggcacatggagctcatcttcgtttttcagatacatttccagagtctgcacttgaaaacggcgcagatatcgtaatccagagtctgcataaaactttgccttcattgacacaaactgccctgctgcacacgcagggcagtcttgtatctgaagaacggttgaagcggtttctttcaatttatcagagcagtagcccgtcttatgtttttatgagcagtatggatgcctgtatccgactgctggagtcttcttcggaagtgttatttaaagaatacacggtacgattaaaggagtgtcgcagaaagctttctgatttgaagcatctgcatctggtcaaaccggatgaagtagtcgggaaaaatggcgtctatgatatggattgttctaaaattattatttcaacaaaggggacttctattgatggagagatgcttcggaaaaaactgcttgataaatatcagttagaaatggaaatgaccgctccgtcttatgtgctggcactttcaagcgtgatggacagtgaagaaggatttgcacggcttgcaggtgcacttttggaaattgattcggcatttgattctgagatgaaaaatcaaataaaggagaaagcgcagacaaaaattgagtttacagataaagatgcaatatgtaccattgcagaggcgatggatgcagactgggaagaagtgaatttaaaagaagcagaggaaagagtgagtacagagtttgcgtatctttatccaccggggattccgtgtattgtgccgggagaaagggtaacaaaagagctgattgaaaaaatagagagctggaaaatgcaggggcttgaagtacagggattgattgattatcatgcacagaagattcgtgtgcaaaaaaggtgaattatgggaaaaatattttatatcatgggaaaaagttcttccggaaaagacaccatctaccgaaagcttcaggaatcagagaatttaaagcttggaagactggtgctttatactactcgtccgattcgtgacggagaaaaagaaggacaggaataccactttgtagatgaggcaaagtattttgaatttgataaagcagaaaaagtgattgaagcaagaacctatcagacagtttacggaccgtggacttattttacagcagatgacggctcggttgatttaagcaaaaccagttatcttgccattggaacgcttgaatcctatcagaatctgaaagcatattatggagtagcgtcgctgtgtccgatttatgtggaggtggaagatggggagcgtctaaaacgtgccattgcaagagaggaaacccagaaagaaccacattatgaggaactttgtcgtcgttttcttgccgatgcggaggatttctcggaagaaaaattagagcaggcaggaattgaaaaacgattttttaataaaagtttagagacgtgtctgagtgaaataacagcatatatcaaaaaacgcttaatagaatcttaatagaaatgttagagaaggaattattgagtgcatttcaatcgtgtggtataatgagaacatattcgaaatggtatcatgttatggtatcacgttatcattttgagacatacaagacattattaggacaaggtgggtgattgcaatgcaggaagttgaaaaagtattgggacacgaagaggtaatccgtcatttgcagaatgcagttgagaaggaacaggtttcacattcttatatttttgcaggagaaaaaggaagcggtaaaaaacttctggcaaaattatttgccatgacattgcaatgcgaggaacataaaaaagagccgtgtatgcattgcagttcctgtagaaaagcaatgagccggaatcatccggacattatctatgtggagcatgtaaagccgacttcgattggtatcgaagaaatccgcgaacaactggtttcggatgtggaaatcaaaccgtataccggtccttataaaatttatatcgtagatgaagcggagaagatgacgatacaggctcaaaatgccctgttaaagacaattgaagaaccgccggcttatgctgtgattctgcttttggcaaacaataataccggacttttgccgacgattacttcaagatgtgtgacactgaattttaaaccggtgcgcgatgaagtcattcgtaagtatctgatggaagaactgcatgtaccggattatcaggcagatgtcagtgtggcatttgcacagggaaatgtaggaaaagcaaaacagattgcaactgcagaagattttacagaaatgatggatgcggctttccgtatcttacgtcgtggaagcgatatggaagtttatgaaatggtagatgcactgaaaaacctttctgaacagaaacatacgatttatgagtatctggatttgtttttagtatggtttcgagatgtgttgttatttaaggccaccaaagaaatggacagtctggtttttaaagatgaatacaattttatcaaagagagagcagataagagttcctatgaggggcttgagaccattatcaaggcgattgagactgcaaaagcgcgtttgcaggcgaatgttaattttgacttaacaatggaactattgttcctgacaatcagggagaactaataaatgacaagagtaataggagtcagattccgtaacgtgggaaagatttattatttttcaccgaaggattttgatatttgtgttggagaccacgtaattgtggagacagcgagaggagtggaatacgggcatgtcgtgcttgctccgagagatgtggaagatgaaaaggtggtacagcctttaaaagaagtaatcagaattgcgactccacaggatgacaaaaaagaagaggcaaaccggaagcgtgaaaaagaggcgtatcagatttgtttaaagaaaatcagagagcacggactcgagatgaaactaattgatgtcgagtatacctttgataataataaagtattattttattttaccgctgatggaagaattgatttccgtgagttggtaaaagatttggcagctatctttaagacaagaattgaactgcgccagattggtgtgcgtgatgagacaaaaatcttaggtggaatcggaatctgtggacgtccgctgtgctgtcacacttatctttctgagtttgcaccggtatccattaagatggcaaaggaacagaatctgtcgttgaatccgtcgaaaatttccggtgtatgtggacgactgatgtgctgtctgaaaaatgaggaagaaacttacgaagaattaaatcgcaaacttcctggaatcggtgacagagtgaccaccgcagatggtttaagaggagaggtgcacagtgtcagcgtgttaagacagctggtaaaagttattgttgatgtggatggcgaaaaagaaattcgggaatatccggtggaagacttaaaattcagaccgcgtcagaaaaaagaaaaattccgcctcagcgatgaggaaatgagagctttaaaagaactggagaagaaataaatgaaagacaagaatgaacgtcttgatgaccttcaaaatggctatatgctctttcagaatccgaaacagttctgttttgggatagacgctgtccttcttgcctggtttgcaaaagccaagccgggtgagagggtacttgatatggggacgggcacaggaatcgtccctattttaatgaaagcaagatatccgaaaggatattttacaggactggaaatccaagaagaaagtgcagatctggcaagaagaagtgtcgcatataataaactggaacaggatattgatatcgtaaccggagatatcaaagaagcaggtgcagtgtttggcggcgcttcttttgatgtcgtaacgacaaaccctccgtacatgattggaagtcatggactaaccggagaaaacagtgcaaagacgattgcaaggcatgaaacgttgtgtacactggatgatatcatagctcaggcagcgaaggtgcttgtgccaaagggaagattttatatggtgcaccggccgtttcgtctggctgaaattatgtcggttatggtaaaatataaaattgagccaaagaggatgcgtctggtacagccttatgcagacaaagagccaaatctggtcttaattgaaggactgcgtggaggaaaatcacggattgaagtggaacgcccattgattgtgtatgaaaaaacgggtgtttataccgatgaaattcttgatatctacggaagaaatcatgaggaaaaattatgagtggaaaattatatttgtgcgcaactccgataggtaatctggaagatatgacgtttcgtgtggtgcgcacattaaaagaagtggatttaattgcggcggaagacaccagaaacagcattaagcttttaaaccattttgaaatcaaaacaccaatgaccagttatcatgaatacaacaagattgataaagggcattatctggtagaacagttattagaaggaaaaaatattgcgttggttacggatgccggaacgcctgggatttccgacccgggagaagaactggttgcgatgtgttatgaggcaggaattgaagtgacatcccttccgggaccggcagcctgcattacagctttgactttatccggactttctacacggcgctttgcgtttgaagcgtttttaccgtcggataaaaaagaaaaaaagaaaatattagaagagttaaaaacagagactcgaaccatgataatgtatgaagcaccacatcgtctgcttcgtaccttagaagaattatttgaaacccttggagatagaaggcttaccgtgtgtcgggaactgacaaagaaacatgagacggcatttgtgacaaccatttcagaagcccttaagtggtatggaaaacatgaaccaaaaggggagtgtgtacttgtaatcgaaggaaagaaccgaaaagaaatggaagaagaagcccagaaaaaatgggaagagatgccgttagaggaacatttggaacattatatgcaacagggaaacgacaaaaaagaagcaatgaaaaaggtggcaaaagacagaggaatcagcaaacgtgatgtatatcaggcactgctgaaaaaggaataaaaatgaagcagatggataaaaaagacttaagcaaaaaggcaaaaatatggttcgaaaaggcaaaagaatggcttaaaagagcaaaagaagccttaaagaaactggaattaaagaaaaaatatgagttgtttaaggaaaagctgccggaggataaaaaagcaagaacgattattctggcagatattgtattagtggttttattgatttttacactgcttctggtaggatgtaaaaacctgttgaccggaggaaagaagcaaaaagaagagacagccatttcagaagaaatggaaaaaacaacaaaacgaaaaaataaaacggtaagttttaccattagtgcagtgggagactgtacatttggaacggatgaaaattttgcttatgagggcagtatgccggcaaaatatgatgaggttggagattttaattatttctttgaaaatgtaaaatctgtttttgaagcagatgatttaacaattgtaaactttgagggtacgctgacagacagtacaacccgtgaggataaacaatttgcgtttaaagcagataaaagctatgcggaaattttaacagatggctttgtagaggctgccaatcttgcgaataatcacagtaaagattatggtgaacagagctataacgatacgatggatgcacttgatgaagccggaattacaaactttggttatgacagggtagcaatcaagaaagtaaaaggcatcaaggttggtctggttggtacttacgtgttggcagatggtctgggcgtgaaagattccatggagaaaaatattcaggatttgaaggatgagggcgcacaggttatcattgcgagttttcattggggagaggaaaaagcagagtatccaaatgatgtgcaggtagaacttgcgcatgctgcaattgatgcaggagcagacttggtgcttggacatcatccacatgtacttcagggaattgaacagtataaaggaaaaaatattgtatacagtcttggcaatttctgcttcggtggaaatatgtatccatctgatatggataccatgattttccagcagacttttactctaaaaggtggaaaactgcaggaagataatgtgacaaatatcattccatgcagtatttcttcggtagaggactataataattatcagccgacaccggcagcgggagagaaagaaacggaaatcttaaataagataacccaaagaagtcagggactttctaatgaaaatacagaagaatctgattcggaaaatgataatagcgattctgatgaaagctatgatgattcggaagatgataatagcggttctgatgagtatgatgattctgacgagtaatattccgattccttcttgtatagaataaaaagaagagtcaaaacaggataaaagtatgctgaatcttttatggggagctatgatgctcatcggcattctgtatggcgcagtgacaggaaggcttgcggaagtaacggatgcagcgttgtcctgtgctaaagaagcggttgcactttgtattacgatgtccggaattgtagcgatgtggatgggaatcatgcagattgcgagaagttcggggttaatcgataagatgacagagaaaatgcagccgcttttgcattttttatttcctaaaataccaaaagaacatccggcaatggaatatatttccgctaatgtcattgcaaattttttagggcttggctggggtgcaacacctctgggattaaaagcaatggaagaacttgcaaaactggaagaagaacgaaaagggaaaaaacccaaatccgccagcaatgaaatgtgtacatttttgattttaaatatttcatcattacagttgataccggtcaatgtcattgcctatcgaagccagtacggaagtgcaaatccggcaggggtgacaggtccggcaatcgtggcaacatttgtcagtacgcttgtggcaatattgttttgtaaatggatggatcgataaaaaagcagtctgcttaaaatttaaccaaatcaagtaagtcccctgcttcaattgcgaaaagcaataagcaggggtggggacttgcttgtatcaggagggggcaagccccttctgataagctgcgtagcagctatttggttatgagcaagtagcgaagcggattgcgaatatccacttgactgcagactgcttttagtacattattcttctttatgtgtgctgaagaattgtttctgacggatatagtaataaataataaacaggatagatgtaacaccccaggagatcggatagcacatcagaataatttggattcctgaaaaatgcggtacaacaaagaaaatccataaaatacgaagtacgcagacaccgccacaggtcatcagcatgggaatcataacatctccaatcccacggagagcacttgagaagatttcaataaagataaataaaacatagcttggtgcaagcaaggaaataatttccattccgactttgataacgccggcatcctgcgtaaagagccggaagagatagtttccaaagaaaatcaaaatcaggcttacaagcagagaggcagcaaggtccatcaaaagacagacagttacgcttcgtttcatccttgaatattttccggcaccatagttttgtccgacaaacgttgcaatcgaaaccgaaaatgcaccggaaatcatccagtaaaaggcgtccatttttccgaatgcagtataggctgccattgcatctgttcccagatgatttaaagaggactgaataatgatattggcaatattgtacatcatagattgaaagcctgccggaagtccgattgtaagaatagagaaaagcaaaaatcggtgcaggcggatttttttcggttcaagctgatacatttcttctggtttcatcaaagcacgaattaccaaaatggcactgacagcctgagaaaataaggttgcaagggcagcgccggtaatgccaagattaaatccgacgaccagaaaaatatccaaaaatacattaataaagcagcagacaatcagataataaagcggtcgtttggagtcacccatggcacgcagaatggccgaaccaatattgtagacaaagacaaagaaaattccggcaaaataaatacgcagataaatgacagaaccggtcattacatttgacggagtattcataaaccggagcatagcgggagcaagtaaaattccaaatacggtaattatgatgcttccgataatggcaagggctgaagctgtatgcagtgccagatttaattcttttttattctttgcgccatagtagcgtgcaatgatgacggttgcaccggaagaaagcccgacaaagaatccgacaacgagattgattagctgtccggaagagccaccaacacaggcaagtgcttcttttccgacgaagcgtccgacaataatggcatcggcagtattgtaaagctgttgaaataatgttccgagcataatcggaaaaaagaaaagcagaagctgtttccagataacaccctccgtaatttgattgacagcagaagttttttgtttcatgactacaccccctggttaaaaaaataaatcaatctgctacttacatatatagcatacaatttcacgaaagtcgatatcatgttttacaaatttttggcgaaaatgtggtataatagacacaagaatttttttgaaaggtgatgttaagtatggaggtaaaattacgagtagcagacccggccggaaatatcacaatttttgttaccagtccggtggaaagaaatttatatgcaaaggttgcaaatgaactgttagcaatcaaagagttccgtggagaacaggttggtttcattgaaagacatgaagatggaagcagtcacatggaaatgatgggtggagaattttgtggaaatgcaaccagaagttttggctatctgcttggaaaggagcaagagtcaaaggacgcctacaaaaagacggtaactgtagatgtcagcggttcttctgaaaaacttgacgtggaagtagattatgaggcaggaacaagtaaaaccatgatgccgcttcctgaaaaaatagaagaagtggaaactgctcagtacggaagctatccaatggttgtctttgacggaattaatcatgtaattgtaaaaggtccaagaagagaagatgcgtttgtacaggcggtgcttgaagctgcaatggcaaaacataaatgtgatgcgtgtggaattatgttcttagagccaagtgcagatggaatggaaaaacgttaccggatgacaccggttgtctatgtagaagaaacaggttctcttgtatgggaaagcagttgtggaagcggaagtatggcaacggcggtttatttaagcaaacagaagaatgatggaaaatatgtttatattttaaaacagccagggggaattattgaagcaacggtcgtaaaggaaaatggaaaaacagtagaatgtaagatgggcggaccggtttctgtttcattagaaaaaacagttgaggttaaggtctgattgatgaagcggtatcgtctgtgtaatccgtttccatcaatcgaaaaagaaggcagtctttcttatgggggaaatcagaattggagcagttctaagactattcgcaaatgcggatgcggagtgattgcaggaacggatttattgttgtaccttgatttaaataaacaaagatgcagaacaaagttttttgaagaagtgcaggattcaaacggaattatcgaacgggaacagtacttaaagtatgtccataaaatgagacgagattatcttccgctgattccacactttggtatgccgggatgggtgctggtagtgggcttaaatgcttatctggcaaaatatcacaccggcttgacggcaagctggggatttggacgcaaaaagttatggaaccgcatgagtgccatgctatctcatgatattccggttattttatccattggtccgaatctgccatttttccggaaaaaagaaaaactgaatctgtatcagaaaaacagtatgggaagctatctttcctcgaataaggtatctgcgcattttgtgacagtcacagagatggacgaagaatggatgcgggtttcttcgtggggaaaagagtactatattaataaaaaagagtatatcggctatatgacaaagtatagcaatgcattattttgcaatgtgtgttacatacgaaagcggaaatagctgaaaaaattcaaaaatctaaaaaaattatacattgcatttttcttgattttggtatatcatcctaatcataacaatcgacaaaaaattaacgagcataagaaaagcggaggagtataccatgaaagagcaaatcatatcctttaagacagtagaagaaattaaagaatttgtaggagcagcctgtaattgcccgtttgatatcgacgtggtaagcggaagaattacaattgatgcaaaatcaattctcggaatgttaagtgtgaactggcaggaagaactttgtgtcatctatgaagcacagaatgaaaaatttgatactgttgtgcagaaatatgcggttggataatgcatctgctacctttacaaaatcagaaaaatgtgttagtctctaaaaagatgacaaacacgatgacggagagagtacgcattgcttttcttttacagagaaattccggtggctgagaggaatgaagaaaactttggggaagatggctcctgagaggtgcaccgaacctgtaatttagtaaaatcaggtaaggctgcaacaggttccgcctgttatagcgggagaggtgtgaaagcacccattaaggtcttggctgtgaggctaagataaaaagaagtggtaacacgggtatatagctcgtcttctttcattctgaaatcaatcaggatgaagaagatgagcttttttggtttgtcaaaaaaattgattcaaagaaacccgttaaacaaaaatgtacgctcggaatctttctgtgtttgattctgtgagcacatagaaaaaagtaaaggagaaaaaatcatggataagaaaaaatattatattaccacagcgattgcctatacttccggcaaaccgcatattggaaatacttatgaagcagtacttgcagacagtattgcaagatttaaaagacagcagggatacgatgtattcttccagaccggtacagatgaacatggacagaaaattgagttaaaagcagaagaggcaggtgtaacctgtaaagaatttgttgataaagtatctggagaaattaaaaacatctgggatttaatgaatacttcttatgataaatttatccgtacaacagatgctgaccatgaaaaacaggttcagaaaatctttaagaaactgtacgaccagggagatatctataaaggatactatgaaggaatgtactgtactccttgtgaatctttctttaccgaatctcagttagtcgatggaaaatgtccggactgcggacgtccggttacaccggcaaaagaagaagcttatttctttaaaatgagcaaatatgcaccgagactgattgaatacatcaacgagcatccggaatttattcagccggtttccagaaaaaatgaaatgatgaacaacttcctgcttccgggacttcaggatctctgtgtttccagaacttctttcaaatggggaattccggttgattttgacccgaaacatgttgtttatgtatggttagatgcgttgaccaactatatcacaggaatcggttatgactgcgatggaaacagcacagagcagtttaagaaagactggccggcagatttacatctgattggaaaagacatcatccgtttccataccatttactggccgattttcttaatggcacttgatttaccacttccaaaacaggtatttggacatccatggctgcttcagggcgatggaaaaatgagtaaatccaaaggaaatgttatttatgcagaccagttagttgatttctttggagtagatgccgttcgttattttgtactgcacgaaatgccatttgaaaacgatggtgtgattacatgggaattaatggtagaacgtttaaattctgaactggcaaatacccttggaaacctcgtaaatcgtacgatttccatgtccaataaatattttggcggagaagtaagaagtacaggagtgaccgaaccggttgatgaagaattaaaatcagttgtacttggaaccaagaaaaaagttgcagataaaatggaagagctgcgtgtcgcagatgcaatcacagaaatctttactctgtttaaacgttgcaataaatatattgatgagacaatgccatgggcacttgcaaaagaagaagataaaaaagaccgccttgcagaagtactctacaatctggtagaaggtatctgcatcggggcttctttactcgaatcctttatgccggaaacaacagaaaagattttagctcagttaaatgcaccgaagagaacttatgaagaacttgatacatttggtttatatccggctggaaacaaagtaacagaaaaaccggaaattctctttgctcgtcttgatatcaaagaagtgatggaaaaagtagaggcaatgaagaaaaaagaagccgaaaaagtcggaacagcagaagaaaagaaagaagaagcggtaattgaaatcgaagcaaaaccggaaattacatttgatgatttcatgaaaatgcagtttcaggtaggtgaaattattgcctgtgaagaagtgaaaaaatccaagaaactgctttgctctcaggtgaaaatcggaaatcaggtaaaacagattgtatctggaatcaagtccaattacaaaccagaggatatggttggaaagaaagtaatggtattggtaaacttaaaaccggcaaaacttgcaggtgtactttctgaaggtatgctgttatgcgcagaggatgaaaatggtaaattggcattaatgacaccagataaagagatgccggcaggtgcagaaatctgctaaaataagagaaaactttctgatatgtaaattacaacagacctccataggtaagatgaaaatcggactatgggggtcttttcctaaaaaggagaaagaaatgatatttgaaacacatgcacactatgatgacgaggcgtttgatggggacagagacagcctgatttgggcgatgcatgaacatggaattgataccattatcaatgttggggcaagccttagaggggtaagagaaacagtaaccttgatggaacgctatccatttgtctatggcgcaatcggtgttcatccggatgaagtcggagatttggatgaagaaaaaatcgcatggatgcgtaagctttgtgaaaaagaaaagacagttgccgtcggtgaaatcggcctggattactactgggataaagagagccatgaaattcagaagaaatggtttgtgcgtcagatggatttagcaaaagagatgagcctgccgattattgtacacagcagaaatgcggcaaaagataccatggatttgatgaaggcagagagggcggattatttaagaggagtgattcactgttattcctattctttagaacatgcaaaagaatacatgaatatgggatattatcttggaatcggcggtgttatcacatttaaaaatgcaaagaaattaaaagaagtagtagaatatgcaccgcttgattatttactgcttgagacggactcgccttatctggcaccggaaccgtatcgtggaaaacgtaactgctcgttgtatttaaattatgtggcagaggaaattgcgagaattaaaaaaatttcttatgaagaagttgtcgagacaacgaagaaaaatgcgcaggaattatttggcgtaaaataagaaaaaatagagaaaaataagcaagaagaaggcttgcttttttatataccgattggtataatagagtacaacaaagacatgcagacagccggagggcagtttatggataataaagaattgataaaaaagtcagcgttgaaccttttttatgcaagaggatatgacgcagttggggtacaggaaattgtaaacactgcagggattaccaaaccaacgctgtattactattttggaagcaaacggggactgcttgaaaatctgctacagagtggatatcagcagttagaggatgaaatcctggacgcaattaataaaagcggagatttaaaagacgtgctttatcgtgttgcgcgcaccttttttgattattgtagcaagcatcagaaattctatttattcatgctgtctcttttttatctgggaagagaaaatgaagcttatcaggtggttgcacctctgattgagcggcattatagaatgatggttaaaatttttgaagatgcggcaggacagcttggaaatatgagaggacgtcaggaattatttgcggttggatttaccggtgtattaaatcaccacattctgactgtaaattacagtctgaaagaaggcgagacgtttcacatttcgaatgagacaacgtatgagattgtgcatcagtttttacatgggatttatacctgaaatggctgcggggtttgacagaaaaagaaaaaataaaaatataaatgatagaaaattatcagtttaaagaaggggaaagcttatggcgaaaaatcaaactttaaagattacggagatggatcgttatctgttcggtcagggaacacattatgagatttataaactcatgggagcacatccgacaaaacagaaaggaaaagacggcgtttatttcgcagtatgggctcctcgtgcacaggaagtagcggtagttggagattttaatggatgggatccaaatgaaaacattatgaaatgtgataatgacatgggaatttatcagcttttcataccaggagtcaaatctggagacttatataaattctgtatcacatcaccatcaggagaactgctttataaggctgacccttatgcaaattatgcagaaaaacgtccgggaaatgcttcccgcgtttatgatatcacaaactttaaatggaatgattctgtatggatgaaaaatcgtcagaactatgatgtaaataaacatgcgatgtccatttatgaagtacatccgggttcatggagaaaacatccgcagaatgaacatgatgaagatggattctataattacagagaacttgcacattctctggcagaatatgtaaaagatatgggctatacccatgtagaattaatgggaattgcagaacatccatttgatggctcctggggctatcaggtaaccggatattatgcaccgacttccagatatggcacaccggatgatttccagtattttgtcaattacatgcataaaaataaaatcggtgttatcttagactgggtaccggcgcattttccgaaagatgctcatggactggctgattttgacggcacaccgacttatgaatatgcagacccgagaaagggtgaacatccggactggggtacaaaagtatttgattatgaaaaaaatgaagtaaagaactttttgattgcaaatgcgctgttttggatggaacaatatcacattgacggacttcgtgtagatgcggtggcttccatgctgtatctggattacggaagagaaaatggacagtgggttccgaataaatacggagaaaataaaaacttagaagcgattgaatttttcaaacatttaaatacagttgtgcttggaagaaataaaggaacggtcatgattgccgaagagtctactgcatggccgaaagtaaccgcacatccggaagaaggaggtttaggattcagcttaaaatggaatatgggatggatgcacgatttccttgaatatatgaagttagatccgtatttccgtcaatacaatcatcataagatgacgttctctctgacttacgcatacagtgaaaattatgtgctggtattatcacatgatgaagtggttcatttaaaatgctccatgattaataaaatgccgggacttggacaggataaaatcgaaaacttaaaagtcggttattcttatatgcttggacatccgggtaaaaaactgctctttatgggtcaggaatttggacagtatcaggagtggagcgaagcaagagaactcgactggtatttaacagcagagtccagccatcgtgaattaagagactatgtaaaagagttgctgaaaatgtataagaaatatccggcactttatgcaacagaccacacagagggtgcatttgagtggattaatgcggatgatgcctgcagaagtatttacagttttatcagaaaatcaccgacaggaagaaataatctgttgtttgtcattaactgtacaccggtagcgagggatgattatcgtgtcggtgttccgaaaaagaaacagtaccgtctggtattaaacagtaaagacccgaaatttggtggggatgtgccggtagagaaaaccgtttatatggcacagaaaaaagaatgtgatggaagagaattttctttcgcatatccattaccggcttatggagttgctgtatttacatattaattagaggacgaagtttttggacttttggggtctgaaaactccgtagaaaaagattgtaaagaagcattaaaacagatagacgaaaagagatatacacaaatgttggagaaagaaggaatcgaacagattctgaaatatggaattgcatttcagacgaagaagtgttgtgtaagaagaggcgagttgtcataatttataccggatgtatccccaaaattgatgaaacaaaatatgatgaagtctggtggattgtccgttccccggataaaattcccacaatagaaaagctggtgcaggaactgagtccttcaaaggaagtatttaaagcatacagaaaggcattccaccttggaatctttgatgaagaatactttcaaactgtttatgtacctgattttttagacgaccttataaaaaatcaaagtgcgctagagaagcttggatggttgtgtgaaaaaagcagagaaaaaaatatcatactgggatgttactgtgaggaagaagcgctttgtcatagaagcattatagcgggaatattgcttggaatgggagcaaaaatagaaacgaaagcagagtatatcaaatattttaaccaaatcaagtaagtcccctgcttcaattgcgaaaagcaataagcaggggtggggacttgcttgtatcaggagggggcaagccccttctgataagctgcgtagcagctatttggttatgagcaagtagcgaagcggattgcgaatatccacatgacaacaatggagtttttggtttgagccaaaaactccattgttgtcattttatcatttgttttatcattcgtcgtagatgtttacaatttctccgtctaaaatacggttcatattttttacagcacagaagtttccacacatactgcaggtatcttctttttccggtttggcttcggcgcggtagcgtcttgctttttccgggtcaatacagatatcaaacatttcctcccaatctaatttctttcttgcaaggctcatctggtgatcccattcgatggcaccttttacgccttttgcaatatctgcggcatgtgctgcaatcctggaagcgatgatgccttcttttacatcatcaaggcttggcagacgcagatgctctgcaggagttacatagcagaggaaggaagctccggatgcagcagcgattgcaccaccgattgcagctgtgatatggtcatagcctggagcaatatccgttactaaaggtccgagtacatagaaaggtgcacccttgcagatagttttctggatttccatatttgcggcaatctggttcattggcatatggccaggaccttctaccataacctgtacgtctttttcccatgcacgtgcggtcagttcgcctaaagtaacaagttcttcaatctgggagatatcagaagcatcttttaaacatcctggacggcaggcatctccaagactcatagtgatatcgtattcacgacaaatgtcaagaatttcatcataatgttcatagaatgggttttcttcaccggtcatttccatccatgcaaaaatgatagaaccaccacgggaaacgatgttggtaagacgacggtttgctttgaaacgtcctgcggtggctttattgataccacagtgaatggtcataaagtcaactccatcttccgcatgcatacgcacaatatcaatccattctttggaagtgatttcttttaatggtttgtggtaataaacaactgcgtcataaatcggaacagtaccgatcatagccggacattctttggtaagacgtttacggaaggtgcgggtatctccgtaagagcttaaatccatgatagattcagcccccattttgactgcattgtttactttttcgatttccatatccatgtctttccagtctctggaaattccaaggtttacattgatcttggttttgagcatagaaccgatagcgtttggttcgattgaagtatggagtttgttacaaggaatgataacctggccttttgccatatattccattaattctttgacatccatgttttctttttttgctgcgatttccatttcttttgtgataatgccttttcttgcggcatccatctgtgttgtgtattccataatacattttctcctttcgcatttgattgataagcttttgtttgaagacgtttagctaataaaaaaaggtgcaccccgacaggtacaccttaatcattcacataaaatatgcttcctacgccggcattatccgtatcaggttcatagggtcgaaatccgttcgtatttcttctcaaccgacgcgtcagctccccttttctttgttttttatatcatatcgtctattctgatatttgtcaagcatagatataagaccatttttttaaatctttgataaaatcttcaacagcctgttcatttgttgcccaggaggtgcagaaacgaagacaggtatggttttcatccggtttgcactggaaagttgtgacataattctcattgatttttttggcgaattcattcgggaaaatcgggaaaagctgattggtaggtgaatcgcataaaaatggaatcttgcagtcgataaagccttcttttaaacgctgtgcaagtgccacactgcgttttccaagttcgagatataaattatcctggaaaagttcttcaaactgtacgccaatcatccaacccttggcgagaattgcaccacgctgtttcatattaaaacggaaatgatcttttaaatcatcgtttactaaaatgagtgcttcaccaaacattgctccgttttttgtaccgccaatataaaaggcatcgcataaatccggcagatcttttaaggtcagctgtgtttcttctacggcaagtgccatggcaagacgtgcaccatcgatataaagatacagattatggcgtttgcagaactgataaagtttctcaagttcttcttttgtgtagacggttccgagttcggttgggagagaaatatagaccagacgaggttctacccaatgctcattttcgtgctgttttaagaccggacgaatcaggtcagcagtcagttttccatcggtacaaggaatagagagcactttatgtccgcttgcttcgatcgctccggtttcgtgtgtattaatatgaccggtatccgcactgatgactgcttcataagggcgcagagcatgcgaaagaaacgtaagattcgtcagcgttcctccggtaatgaaatgaatatcaactccataattttccagtgcttcctggattttatcgcgggcattatcgcaatgctcatctaatccgtaagaattattttggtggtagttgatggtttcaagtgcgcgaagaatatttggatgtgctccttcgctgtaatcattctgaaaactgtacataataaaaatccccttttttcaacaacatctttcatctcattctaacacaattttcgtaaaaagaaagtgaaaagatttagaagagaaaattaattgacgatggactggacaatttcgagttagttgtggtaaaatcctaaaatagatgataaacaggggcggaagtactgaaagtggaactttcgtccccttttaccgtgctatacaaaatgtactcttggagtctttaaacatttgttttggaaaggaagtaattgaagatgacaaaaattgatattttttcaggatttcttggagcaggtaaaacaacattaatcaaaaagttattaaaagaggcatataaaggcgagcaggtcgttttaattgaaaatgaatttggtgaaatcggtatcgacggcggtttcttaaaggaagcaggagtagaaattcgtgaaatgaactccggatgtatctgctgctctttagttggtgactttggaactgctttaaaagaagtaatcgcaaagtatgaaccacagcgtatcgtaatcgaaccatcaggagtcggaaaactttctgatgttatcaaggctgttcagaaaatcgaaaacgaagttgaaatcaaattaaacagctttacaactgtagtggatgcaacaaaatgcaaaatgtatatgaaaaacttcggtgaatttttcagcaaccagattgaatatgccggaactgttatcttaagcagaacggataaagcttccgaagaaaaaattgcagcggcacttgagattatccgtggactgaatcagacagcagcagttatcacaactccgattgaaaaactttccggagaaaagattttggatacaatggaaaataaccgctctttggaaaaagaattaatggatgaagaagtttgcccggtatgtggtggacatcatgaccatgagcaccatcacgaccatgaagaatgtggatgcggacacgaccatgagcatgaccatcatcatgaccacgaccatgaagaatgtggatgcggacacgaccatgagcatgaacatcatcatgaccacaaccatgaagaatgtggatgcggacatgaccatgagcatgaacatcatcatgatcacgaccatgaagaatgtggatgcggacacgaccatgaccatgatcatcatcatcaccatcatgcagatgaagtgttcacaagctgggggaaagagacaacaaagaaatatacaaaagaaggaattcatgagattctggaagcactctctaaccataatgacgagtacggaatggtactgcgtgcaaaaggtatggtagagggcgaagatggacagtggatttactttgatatggttccaggtgaagcagatgtacgtgaaggtgcaccggaatacaccggaagaatctgcgtcatcggttctaagatgaatgaagcaaatctggccagattatttggtcttgcataatcaagatacgagagaaaaataacaatacaaataagcttaaggtgtgagtgttgaactgaagttttgacactcacatcatgatatttaagaaaggttatgaaaaatggacgaatttaaagtaccgatttaccttatgacaggttttcttgagagtggaaaaacatcatttttgaattttacactcgcacaggagtattttcagattgatgaaccgactcttttaattctctgtgaggagggtgaagaagaatacgataaaaaagtgctgaaaaaaagccgtacttctgtagaagtaatcgacagcattgaggagctgaccacagagcgtctggttgcttatgatgcattttataatccgggtcgcgttatcattgaatacaacggaatgtggcaggtaagcaaattagaagaactgacatttccgtctggatggggaatcgaacagcatattgtgacagtagatgcaagtacctttcaggtataccttaacaatatgaaatccctgtttatggaaatggtaagaaatgcagatttagtattatttaaccgtgcagataccgaacttccgcttgcaaatttcagaagaagcattaaagttgtaaatccgggtgcagaactgatttttgaagatgaagagggtgaaatcgaggatatctttgacggagaaatgccatttgatgtcaaggccgagacgattgaaattccaaatgaggattatggaatctggtatctggatgcgagagaccatgcggatacttataacggaaagaaagtttcttttaccggaatggtgttaaaatccagagaatttgctaaaaatgaatttgtaccgggacgtatggcaatgacctgctgtgcagatgacacaacatttttaggatttgtctgcaagagcgatgaagcacgtcatctaaaaaccggaaaatgggtgaatgtcgtagccaaagtgaaatatgaatttgtaccggcttacggtgaaacaggtccagtactctatgcgatttctgtggaagagacagaaccgttaaaagatgaactggtatattttagttaaggagctgatatgtatttaatagtaggacttggaaatccaggaaaacagtatgataaaacccgccacaatatgggatttgataccattgatgaattgatagaccgtcatcggattgccggatctggaatcgaccggaaagcgatgtatggcaagggagtgattgccggagaaaaagtcattcttgcaaagccgatgacctatatgaatttgagcggagaagcagtcagggaattaatcaattattataaaatggatgcagagacagaactggttgtcatctatgatgatattgatttggacccgggacagataagaatccgtaaaaaaggcagcgccggtggacacaatggaatcaaaaacattattgcccagcttggaacccagaatttctaccgaattaaagtaggagtcggagcaaaaccaaagggatgggatttggcagattatgtactgggacgttttgataaagacgaacgtgttctggtcgatgaagcaatcaaagaagctgccgatgcagtggaattaattttagcagagggcattgaaactgccatgaaccgttataacgcaaaaaagaaataggaatgaaataaataaattgagggagaaaacatgcaggcacttttgcagccactttcaaaacttggtgaatacgaagaaattaaaaacagaatagagaaaaatcgtgggattttacagcttgccggatgtattgattcgcaaaaagcgcatgtcatttatggactgggtcaggaaaagaagaaccgtcttgtcattgcggaaaatgaattaaaagcaaaagagttgtacgaagatttgaaattttactatccggatgttttttattatccggcgagggatttaattttctttgaagcagatattcatggaaatctgctcacaaaacagcggatgcaggtaattgcagcacttttggagaaaaagagtgtgacggtggtgacaagcatcagtggctgtatggattatcttcttccgatttccgtacttaaaaagcatgtcctgcattttaaaaatgacagtgtgcttgataccgaagcactcaaaaaagagttgattaatatgggatttgagtacaatgcgcaggcggaggcaccgggacagtttgccatgcgtggtggaattgtggacatctttcttttgaccgaggaaaatccggtgagaatcgagatgtggggcgatgagattgattctatccgcagttttgatgccgaaagtcagcgttccattgaaaatctggacgagattaccatttatccggcagaagagatgatacttgatgattcggttttggaaaaaggtctgatatccattgaaaaagagcgggataagacgatacaggcatttcgggatgcctttttgccggaagaagccggacgtatcaaaaatatggtaaatgaagcagtcagcgcaatgcgggaatttcatgatttttcatcagcagaacattttatccgatatttttataaagaaccggtcacttttttagactattttgaggaggaggatacactcctttttttagacgaaacaaatcatcttttagcaagtgtggaagcagtggaaacggaattccgtgagagcatgaagcaccgccttgaaaaaggttatcttctggcaggacagacagatttattatgcgggaaaaaactgctgattcataaaattaatcagaaaaacggcattggaatctgtacgatggaacagcagaaagaggactggcagataaatgattccttttatctgacaaccaaatcggtaaattcgtataataacagttttgaacttttaataaaagatttgaaaaactggaaaaaacggggatatcaggtgttgctgttgtccggttcaagaacaagggcgaaacgtctggctcaggatttattaaatgaaggcttgacggcggtttatacggaggatagaaatcgtgaaatccatgagggtgagattgtaacgacgtatggatatgccagaagcggatttgagtatccgatggtgcgttttgttttgattactgaaagcgatatcttcggaaaagagaagaaaaagaagcgaaagaaaacagaatacagcggaaagaaaattcaaagtttttcagaactttcgattggtgattatgtggttcatgaaaatcatggattgggaatttaccgtggaattgagaaagttaccgtagataaagtagtgaaagattatattaaaattgaatatgcgggtaacagcaatttatatattctggcaactcagttagatttactacaaaaatatgccggagcggatgcacgtgcgccgaagttaaataaattaggcggtcaggaatggaacaagaccaaaacaaaggtgcgtggagcagtaaaaaatattgcaaaagatttggttgctctttatgctgcgagacaggagaagaatggttactgctatgaaccggatacggtctggcaaaaagagtttgaagaaatgtttccatttgaggagacggaagaccagttagcggcgatcgaagcgactaaaaaagatatggaaagtaacaagattatggatcgtctggtctgcggggacgtcggatatggaaagaccgaaattgcaattcgtgcagcatttaaggcggttcaggaagataaacaggtggtctatcttgttccgacgactattcttgcacaacagcattacaatacctttgttcagagaatgaaagattttccggtgcggattgatttgctttgccggtttaagacttcggcagaacaaagaaaaaccattgaggatttgaaaaaagggtttgtggatatcgtaatcggaacgcatcgattgttgtcaaaagatgtggtctataaagatttgggaatgttgattgtggatgaggaacagcggtttggcgtgactcataaagaaaaaatcaaaaaactcaaagaaaatgtggatgtattgacgctgacggcaacaccgattccgagaaccctgcacatgagtctgattggaatccgtgatatgagtgtattagaagaagcgccgatggatcgtatgccgattcagacttatgtgatggaatataacgaagagatggtaagagaggcgattaaccgtgagctggcaaggggcggacaggtttattatgtgtataaccgtgtcaatgatattgatgaaatcacaaatcggattgcaaaactagtgccggatgcaaatgtagcctttgcacatggtcagatgccggagcatcagttggaaaaaattatgtatggatttatcaacggagaaattgatgtgctggtatccacgacaattatcgagactggtctggatatttcaaatgccaataccatgattattcatgattctgaccggcttggtttgtcccagctttatcagcttcgtggtcgtgtgggtcgttcaaacaggacttcttatgcctttttaatgtataaaaaagataagatgctaaaagaagttgccgagaaaagattgcatgccatccgggaatttacggatctgggaagcggatttaagattgcgatgcgtgatttggaaattcgcggtgcgggaaatcttctgggtgcagaacagcacgggcatcttgaagcggttggatatgatttgtactgtaaaatgctcaacgaagcggttcaggaagaaagaggaatggaacaggcagaagagtttgagactacaattgatttggagatggatgcctacattccgccaaaatatattccaaatgaatatcagaagctggatatttataaacggattgccggaattgaaaatgaagaagaatatgaagatatgttagaagaactgatggatcgttttggagaaccgccgaaggcggtacagaatttgcttgcaattgcaaatttaaaggcgcttgcacacagggtttatgtaagagaaattaagcagatcaatcaggaagtaaaagtaacgatgtttgaacgtggaaagttaaaaacggaggggattcctgcaattttagaaaaatataaagaccggatgtctgtgcggacaggaaaagaattttatttcctgatttccctgaaaggaagaaaagcgaaagagttctataaggcgctcgacctggttttggaaattctccatgagtttgaggcattattaccagaaagttcacaaaaaatcccttgctcaaaggaacaataaagattatacttaacaagtacaccaaaagtacatcaaatatcgaatggaaatgaaaatacgggaggaattatgaataaattaggaagggttcttgcctgcacgactcttgcggcaacattgacaatgaccagtttgactggatgtggaagtacattagatggaacgaagacagtagcgacggttggaaaggaagaaattacagccggaacagtgaatatgatgcttcgtatgacccaggctcagatgatgtcttactattccatgtttggaacatccactacaggaatgtgggaaaataaaggcgatgatggcaaaacttatgcagaaagcaccaaagacgacattatggatcagcttcataatctggtattgttagaacagcatgcaaaagattatgatgtaactatcacagataaagaacagaaagaattaaaagccgcagcagaaaaatttatgacagataatgatgcagaaacgattgcaaaactcgcagtgacccagtccgacattgaaaaactgcttgagttatacagctatcagacaaagatgtatgacccgatgacagctgatgtagatacaaatgtagaagataaagaagcacagcagagtaaaattacgtactgcaaagtttctacagaagcgactaaagatgatgagggaaattctacagagttgacagatgaagaaaaagctgcaaagaaagaccaggcacagcaggtattagataaaataaaagcgcaggaagatattgccggcgcagatgtggacagtcttgcaaaagaagtggatgagtcgcttagttcgtctactgcaacttacagcacaaatgaagacgataaagattcctctcttgatgctgacgtaatgaaagcagcaaaagaactgacagaagatggtcaacttgcttctgatgtcatcgaaggcagtgacggatactatgtagtccgtatggacagtgtttttgataaagattctactcagacaaaaaaagacagcattgtaaaagaaagaaaacagaaagcttatgataaactgcttaaaaaatgggcaaagaaaacgaaaatctcagttaataaaaaagtatggaaaacagtaacattaacagatgaagatgtttacagcttcaaacaggctgatacatcaagcgaaacaacagacagtacagattctgcagaaacaacagaagcaacagaaaatacagatagttcagaagcagaagaaagcactgagacaacagaaaatacagaggaatcctctgacagcacacaggcagatgaaaattcagatgcaggtgaaaatgctgatacagaagcaaccgaaacagctgaataataaaaaaagtccgttatcactatttatatttaggtgataacggactttttaacttataaacgactctggcggaatttttttcgataatcccttggggtcattttttgtgctttataaaaagcacgtgtaaaatagttctggtcattataaccacagtgaaatgcaatttctccgatactcaaatcagaagattccaataagcgacggctgtttttcagccgaacctgactgatatgagtatgaatggaaattccgtaagtctctttgaattttctggtgagagaggaacgactgcagaagaactgggagcagaggttatcaatggtgatatgctgtccatagcgttcttcaatgtagctgtggacttctgaaaccaactcttttttcgttaactgcatacggtttgtcagagtaatatactgagcgcagatttccatgattgtaacaagggagtcgattgtctgacggtcactgaccggaatctgggcaatcgtatcctgcaacaattcatagtcatcttttttcatataaggaagcgcttttttgaatgtctcttttgcagcttcttttcctttgttgatggtctgacccatcatcagatatccggttaaagtaccgaaactataaagcggggcaactgcctcatatagccctaagtggcatttataaatgtgaagccgtttttcatcctgtactttacgaaatgccatgatatcctgttctacgcagtgttttcgacctttcggattttcctgtatcagcgaacagagacagccgagttctttcgggaaagcagcaatttcctgaaaataagtatcgtaaacactgatacggaagccggatatatgataaagttcttttaaaatcttttcgattgaaattgtctgctccataaagaattcctccttaaatttcagttgaacagaaaaaatttagatgtattttgtgacaatctgtttcatatcatccattttacgttccatgtcagcaaccagaatcatctgagtgcgagtgcggtcaagattatgatgttctctttggattttaaagtaggtatctccatttaaataatcagtaaggaaacgaagtccacattcgagagtcatcagttttgcagaaaatggaatcagttcaatttcttctttcgttaaagaatcgcctgcttcagaaagaaaaccggcagtgtaagcttcaaagagttctaagctcatggaaactttggttaaatcaatttcatcttcggcagcagtgcttgcgccaaaacggatgctgtcaccaaaatcgtataaaacagaaccaggcattacagtatccaaatcaatgacgcagattccctcgtttgtggtattgtccatcataatgttgttcagctttgtatcattatgggttacacgaagtggaagttttccggcattgatggcatcaactactgtttttccgtcggtttcacgctccagataaaattcgatttcctgctgtacattttttgcacgaccttttttatctgcttttatggccgctttaaaatcttcatagcgggatggagtgttatggaaatttgggatgatttcatgcagggtgtcagctggatagtcggcaagcagtttctgaaaatgtccaaacgcttttgcggcatttttgaagatttcaggagaagaaacggtctgatagcaggttgcatcttcaataaaagtatagcttctccagtaaaccccttcgctgtctttaaaaagggaagagccggattttgtaggaataacagtaagagttccacggcttgggtcttttccctgctcaattagttttttccttaagtgagaagtaacgccttcaatattttccatcaatccataagggtctttaaaaatagaagtattgatagcctgaaggatgtagcggacaggtggtttcgtttcacggctgaaataaacggcaaacgtactgttgatgtgaccacagccaaatggttcttcataaataaatgtaccgttatacagaaactgaggtacgatttcattttttattttttcagagatagacatggttttcctcctgagctttaaattaaattcttatttcttaattatataaaaaagaaaagaaaattctatagaaaactgactcataaatagcaaaaacaggagaaaaagataaaaaatgctaaaatgaaagagggtgggatttttaaggctgatgcagagtataatgaaagaaagaataaaaatggggtgtacagggataagatgagagttctgctgtttttttcagaaatgataattccactgattttattttacgttgtcggtttcggtgtattaatgaaatgtgacatctatgaggaatttgtaaagggcgcaaaagagggcttagagacagtcattcagattcttccaacattaatcgggcttatggtggcagtaggagtcctgcgtgcttcaggatttttgaccatgcttggagaagtgctcggaaaggtgacagagccgtttggatttccgtcggctttagtaccgcttacaattgtgcggatgttttcttcaagtgcggcaacagggcttttacttgatgtttttcgggaatttggaacggattctcgaaacggaaaaattgcttctattatgatgtcgtgcacggaaacaattttctacacagtgtcggtgtactttatggcagcaaaaataaaggatacgagatacacgatagcaggcgcatttcttgcttctgcggtgggaattgctgcaagcgtatggcttgcaggctacatggggtgaaaaaggttgacaaccccaaatttagatgttactatggtagcacgttaaaatatgaaaaatggatattataatggagtgagcgagagaacccacggttttaatcgtttgaaaatacatagaaaggcaagggtcgaaaaagaaaaatgagatattatgataagataacaccagatggaacaaaagatttacttttcggtgaatgtgaacagcgttcacaggtaacaaagaccctgaaggacttgtttacagcccaggggtatcggagggttatgacacccgcacttgaattttatgatgtatttggaaaatcagcggcgaaatatctgccaaaggaaagtatgtataaactgatagaccataaaggaagactgatggtactctgtccggattgtaccgtacctgtggccagattgacggcaaccagattaaaaggaatgccgatgccgcttcgtttattttataaccacaatatttaccgtatgtttccggagttaaaaggaaagagtacagaaatcaatcaggtgggaattgaactgattggcggagaaaaattaagaagtgaccttgaagtggttgaacttgcagcaagatgtttaagtaccatcggaaatggaaaataccgtctggaattatgtgatatcggttactttaaggcgattatgaacagcctggatgtggatgaagacaccaaagaagaaatccgttatcagattgaacagaaaaactatgcttcgcttacagatatgcttggaaaatacaaagacagcaaagcagcgcaggcacttttgaagctgccaagattatttggcggtgcagaagtatttgaaaaggcgtatgaactatttgatgaaaatggcgcaaaagaaagtctggattacttaaagggaatttatgaatacttgcaggcactgggacttggtgatagagtaatcatcgatttgggacttgttaacctggcagaatattataccggaattatcttccgcggttatttccacggaattggagagcaggtgctttcaggcggtcgttacgaccagcttctgcatgattttggagtggaagaatgttctgtcggatttggaatcaatgtagatttggcaagccagaaagtaaaaacggtagaggaaaatataccggaagtgctggtatttgcaccggatacgaagtttttggcaaaagcagtccatcatcgcagagaactggaagaccagggcatgctgacggaaaactgcgtttttgatacaatggaagaagcatttgattatgcaaaaatgagaggaataccgaaagtgcatctggtgggagatgatattaccgtttgtttaacgaagaaaaaataggaagtatagctactcactgggaggcaatgaaagatgaaaccaattagaattgcgcttacaaaggggcgtttagaaaataaaacagtagaacttttagaacgtttaggatatgactgtaccaatgccagaaaaaaaggcagaaaattaattatgccaattggaaatggtgaaatcgaagtcgtgcttgcgaaagcggccgatgttgttacttatgtagaaagtggtgtctgtgacatgggtgtagtcggaaaagataccatcatggaaaaaggcggaacattttatgaagtggcagatttaggatttggaaaatgtcgttttgctgttgcaaccttaaaagagaaagacttatatgaaggctatcgaactttaacgattgcaagtaaatatgtcaatgtcgcaaaaaattattttgaacaaaaaaacatggatgtagatgttgtaaaaattgaaggatccgtagaacttgcaccggtacttggacttgcagatgcaattgtagatattgtggaaaccggtacaactttaaaagaaaatgggcttgttgtaaaagaagaggtgtgtccggtcagtgccagactgattgttaacatcgcaagcatgaagcttagaaaaaaagaaatcgaagaattaatcgataaaatcgaaaaagatattaaaaaaagagcaaaggaggcctagaaaatgacgtatgtattaccggaaaaattaaaagacttaaatccttacgaccctgtaacggaggattttcggatccatcttgatgcaaatgagagtttctgtgaagtaccggaaaacatcaggcaggaaattttaaatgcggtttctaatgttgcatttaaccgttatcctgatccgtacgcaagaaaattatgtgaaaaagcaggtgcatattatcatgtagacccgaaacttttaactgccggaaatggttcggatgaattaatttctctggtagtaccgtattttctggacgagggtgatacgatgcttgtcgcagtaccggatttttccatgtactggttttacgcaccgtttcacaaaatcaaagtagaatcccttcaaaaagaaaacagcatgaagacttctgcagaagagattttacagcgtgcaaaagagaaaaatgcaaaattgctgattttctccaatccgtgtaatccgacttctcttggaatcggacgtgacgatatcataaaaattatcgagggtacagatgcgctggtgattgtggatgaagcttatatggaatttgaaaacgaaaataattccgtcttaaacgaagtagaaaattatgataatttaattgttttaaagacctgttcgaaggcatttggaatggcagcaatccgccttggaattgcagttaccaacgaaaagctgacaggaattttacatgcaatcaaagcaccgtataatgtcaattccgtgacacaggcaatcggatgcgtattattttctcacccggaatatctggcttcctgcattgatgctttaaaggcatccagagacgagttatatcaggcggtgaaagcgatggaagataaaaaaacagaaatcgaaaccgtctacgagacgagtacaaactttatttttatgaaggtaaaacgtgcaaaagaagtgtttgaagcattaaagcaaagaggcatttcgattcgatttatgaatggctatcttcgagtaaccgcaggaacaaaagcagaaaataaagaagtgatggaagcactttgggaactgattcagtaggaggcggatatgagagaaaagcagattataagaaccacaaaagaaacagacatcaatctgactctgaatttagatggaagcggaacgtataacggaacttgcggagttggattttttgaccatatgctgagtgcattttgtgttcatgcggggtttgatttagaccttaagatgaaaggcgatttggaagtagactgtcatcacagtattgaagatttgggaattgtgctgggacaggcatttgcggaagcagttggtgataagggaagtatctgccggtacggaagtttttatattccaatggatgaggcacttggtttttgttccctggatatcagtggacgtccatttctggtatttgacgcagagtttaccaatcaaagtgtaggaacattggactgctgtatggtaaaagaatttttccgggcatttgcatttaacggcggaattacactgcatttgaaatgtttgtacggcgaaaatgaccatcacatcatagaggcattatttaaggcagtggcacatgcattaaaagaagcagtaaagccaaatggcggacaaatcttatcttcaaaggggatgctggcatgatagcaattattgattatggggcaggaaatctgtttagtgtaaaaaatgcattggattttttgcaaaaagaaagtacaataacagaggatgcgcaggaaatccgtaaggctgatgcaatgattcttccgggagtcggagcatttccggatgccatgcgcatgttaaaagaaaaaggacttgataaagttatctgtgaagaagcacaaagaaaaccgctgcttggaatctgtttaggcatgcagatgttatttgagacaagctatgagtttaaagaaacaaaagggcttggactcttagaaggcagtgtcgttccaattgatggaggcggattaaaaattcctcacatgggatggaataatctgaccgtattaaatccatgcaagattacggaaggactaaaagaagatgcttatgtgtattttgtccactccttccgtgcagaaacaaaagacgaaaatatttcctgctatacgatgtacaatgagaaaattccggcacttgtgcataaaggatttgtatatggagcgcagttccatccggaaaaaagcggttcggtgggactgggattactcgaaagatttgctgatttagcgaaaatacaggaggaagagcgatgattatattaccggcaattgatattaaagataaacaatgcgtacgtctggtaaagggagattatgcaactgctcatcaggttgccgaaagcccttatgagactgcaaaatcttttaaagctgcaaatgcctcctggattcacatggtagaccttgacggtgcaaaggaaagaaaaccagtcaatcaggagatttttgaacgtgtggcaaaggaatccggattaaaagtagaagtgggcggaggaatccgtgacatgaaaacaattgaatattatctggagcgtggaattgagagggtgattcttggttctgtcgcagtaaaaaatccggagcttgtaaaagaagctgtaaaagaatttaaagagtgcattgcggttggaattgatgcaaaaaatggaatggttgcaacagaaggctggctggaaaaaagcgatgtcagttatctggatttgggacttgcgatggaagacgcaggcgtaaagactattatttttaccgatatttcaagagatggaactttaaccggagttaataccgaacagcttggacgtttaaatgagaccgtatcctgcaacatcattgcaagtggaggagtcagttccatcaaagatattgaagattgcctggagttgaatctgtatggatgcatctgcggaaaagcactttacacaggagcattaaacttagaagaagcagtgcgaaaggcgggtgtgcagacatgttagcaaaacgaattattccgtgtctggatgtccgtgacggaaaagtggtaaaaggtgtcaattttgttggaatcaaagaagtcggagacccggtggagtgtgccattgagtatgacaaacagggggcagacgaaatctgttttctggatatcacggcgacccatgaaggaagaggaacaatggttgatgtcgtcagaagaacggcaaaacatgtttttgttcctctgacagtaggcggaggaatccgtacagtagatgattttcgtgagattttaagagctggtgcggataaagtctcggtcaattcagcagcagtcagacgaccggagctaattcgtgaagcagcggaaatctttggaagtcagtgtgtggttgtcgcaattgatgccaaacgagatgaaactggcacatttaaagttgtggtaaacggcggaagaattgataccggattaaatgccgtagaatgggcaaaaaaatgtcaggaacttggtgcaggagaaatccttctgacttcaatggatacggatggatgcaaagaaggatttgacctggaactttgcaatgccgtctgtaatgtggtcagtattccggtcattgcaagtggcggatgcggaaaactggaacatttttcggaagtgtttgaaaagagcggtgcagatgcggcacttgcagcttccctgtttcactttaaagagctgactgtcgaagaagtaaaagaacatttaaaggaatgcgaaattccggtaaggagatagagatggattttgaccgttattttgtaaaaggggagttgattccggcaattgtgcaggaagagggaaccggagaagttttaatgcttgcctatatgaataaagaaagcctgaaaaagacatttgagacaggatatacctggttctacagccgttccagacaggaactctggaataaaggtgcaacttccggccatctgcagaaagtggtagatatcaaatcagactgcgatgatgatacgcttttagtgactgtgattcagacaggtgctgcctgccataccggaaatcacagctgtttctttacagatatctggaaagaaggaggagaacgtaattagacgttttttaatgataacaggcaaggtgctcttggcacctttcctgttttgtttattttggatttcaagaatctttgaattatttttaaagatttcaagaccaattgttacgattctatgtgcaatcggttcggtaggaattacaatcggggcaatcatccatatttttttctatcttcagggaagaggaatcagtgtatgggggattgtcctttcggtgttttttgcagcagccctgatggttgtgccggcagcaggtgttggagtggtaatcgtagtgttggagggaatttgcaatggaatttatcgaatgtaccgtccggcgatggaaaagatgaatctggaagaagagaaaaaagattatcatcttgcggaatgtgagtgggatgaaaagacaccggacgctccctggaaaaataaagaagaatgcgaacgaagaattcattattttaaaggggtaaaagataaagaagaactggaaaaacggctttccgggctcttacggatttaccgaccagagaaagaatttgccgaagatgcactgacacgaagcattttggatgaatttgagtatctaaagggcaggcttccggagaaagcaaaagatgtatgatgaaaaatgcaaaaaccgcccgaagaaatcctgtccgagaagttgacaagaccttgaaaagcgatataataaaagaataaagaatgtttaaaattcaattattgtggaggaatttaaaatgaaagtattagttgaaacatctgcaagacatttacatttatcacaggaacatctggaaatccttttcggaaaaggtcatgagctgacagtgaaaaaaatgctgagccagccgggacagttcgcatgtgaagaaaaagtacaggtaatcggaccaaaaagttctttaaaaatgtctgtattaggacctgtaagaaaagatacacaggttgaagtatctttaacagatgcaagagcaatcggtgttacagctccaattcgtgaatccggtgatattgctggttcaggtgcctgtaagctggtaggtcctgctggtgaagtagaactgacagaaggtgtaattgctgcaaaacgtcacgtacatatgactccggaagatgcagaagcagcaggagtaaaagataaagacatcgtaaaactggacatccagtctccaaacggtcgttctttaacattcggtgatgttgtagttcgtgtaagcgcaagctatgcaacagctgcacatatcgatacagatgaagcaaatgctctttgcccaggtaaagaatgctacggtgaaatgattaaataattaaaaacagtcatgattgaaagtcctttagatgagaaaactcatttaaaggactttttttgattggaatcagaggcaaaatcagcgcaaaacgtcatacttgtgcaaaatgcaccaaaaccgtccatgattttcgtatattaataatggttgattttgattgattttgaatgaaaatgattgtataatacagtcatagcaagagagaacaagaaagaacagaacaggagggaaaatatgatttatacagttacatttaatccatcccttgactatattgtttctgtgaatgggtttgaacttggaaaaacgaaccgtaccgattcggaactcttattacctggaggaaaaggaattaacgtttcgattgttttgaaaaatctgggaatcgataatacagcacttggatttatggcaggatttaccggagaagagattcagcgcagagtcgaagagattggcgtaaaggcagatttcatttcaatcgaagacggaatttcaagaatcaacctgaaactgaaaaatattgagggaacagaaattaacggtcaaggaccaaaaatcagcaaagaaaaacgagaagaactgcttcagatattagataaactaaaagaaggcgatgtgctggttttagcaggaagcatcccatccagcttaccggatgacatttacaaaaacatcatgaagcgtctggaaaagaaaaacattctgattgcagtggatgctacaaaagatttacttttaaatgttttagaacatcatccatttttgattaaaccaaacaatcatgagcttggagaaatctttggagtggaattaaagacgagagaatccgtcattccttatgcgaagaaacttcaggaaaaaggagcaagaaatgtgctgatttctatggcaggagagggggcagccctcgttgcagaagacggaagtatttatcttgccgaagcaccaaagggaacactggtaaatggtgtcggcgcaggagattcgatggtggcagggttccttgcaggttggcttgaaaaacacgattacagacatgcattccatacaggaatcgcagccggaagtgcaagtgcattttccgaatatctggcaagcagggaagaggttcaggctgtgtatgagcaggtaacatcaaaagaatataaagaacaataaggaaagagagggagaagtaaaggtatgagaattacagatttactcgatgcaagaagtatttcgcttgactgttcgccaaaaacgaagcaagaggcattggatacagcagttgccctcatggtaaagagcggaaaaattaatgacgaagaagcttacagacgtcaggtttatgcaagagaagaagaaagtacaacaggaataggagaaggaattgcaattcctcatggaaaatgtgatgccgtaacaaaacctggtctcgcggcaatggtaatcaaagatggtgttgatttcgatgcattagacggagagccggttaccctgctgtttctgattgcagcaccaaatacaaaagataatgtacatctggatgtattaagtaagttatctgtacttatgatggatgaagatttctcaaatggactgagaaatgcaaaaagtgtagaagaatttttgaaaatcattgacaaagccgatgatgaaaaaccagacattgatgaacgtcttgaagatacaggagcaaaagaagattccaaagtaaaaattcttgcagttacctcttgtccgaccggtattgctcatacttacatggcagcagagggacttgaaaaagcagcaagagccaaaggatgctttattaaagtagaaaccagagggtccggtggagcaaaaaacgtgctgacagcagcagaaattgaagaagcagactgcattatcgttgctgccgatgcacaagttccgatggatcgtttcgatggaaagaaattaattgaatgtcaggtatctgacggaatcagcaaggcagaccagctcgttgaacgtgcgatggcaggagatgcaccgatttatcaggcaaagggtgcagtacaaaaatccagtcagtcaaagggaagcggaggggttggacatcagatttatacacagcttatgaacggtgtttcccacatgcttccattcgtagtcggtggtggtatcttaatcgcacttgcattcttaattgatggtttaagtgtagatatgaattctcttccggttgaccagagagcaaactttggtacaattactccggttgcagcgatgcttaaaggaatcggtggtacagcattcgcattcatgctgccgatacttgcaggatttatcgcaatggcaatcggtgacagaccggcacttgcagttggttttgtcggtggtatgattgcttctcagggaaaatctggtttccttggtgctttagtagcaggttttgcagcaggatacatcattgtattacttagaaaattatgtgacaaacttccacaggcaattgagaaaattgcaccggttctgatttatccggtagtcggaattctagttatgggattattaatgaacttcgcagtagaaccgattatgggtgcaatcaatactgcattaaataacggtttgacaagcatgggcggttctagtaagattattttaggatttatcttaggtggtatgatggcgattgatatgggtggtccatttaataaagcttcttatgtatttggcactgcagcaattgcttccggtaactacgatgtcatggcagcagttatgattggaggtatgactcctccatgtgcaatcgcacttgcaactttattatttaaaaacaaatttacaaaagaagaaagagatgcaggtcctacaaactttatcatgggactggcatttatcacagaaggtgcaattccatttgcagcatctgacccgcttcatgtacttccggcatgtgttatcggttccggaatcgcaggttctttaagtatgttattcaactgcactttaatggcaccacatggtggaatctttgtattccctgtagtcggaaatccgtggatgtacctggcggcactggtagttggaacaattgtttccactgtactgcttggaattttaaagaaaaaagtagaagaataagaaaaaattaaaattaagaaaataaaaagcaagaaaataaaattaaaacaagaaaaggagaatttaccatgaaagaatttaagtacacaatcacagatccagaaggaattcacgctcgtccggcaggagaacttgtaaaagctgcaaaagagtttgcaagcacaattaaattaaacaaagacggaaaagcaggagactgcaaacgaatcttcggaattatgggactcgctgtaaaacagggaaatgaagttacctttacttttgaaggggaagatgaagatgcagcttatgaagcaatcagcgcattcgtgaaagaaaacctgtaagaaaaaagcagaacatgaaataaagccggggtcaaattagttttgacccctgtttttttaaaggaagaaaggggaagttagcgatgcagatttatagtggaaaaagtgtatttagtggaattgcaattggaaaaatctgtgtatatcagaagagcgagcagcaggtaaaacgtgtacgtacagaagacagtgaaaaagagtgggcacgttataacgaagcaaaagagaaggcattggaccagcttcgtggtttatatgaaaaagcattaaaagaagtcggtgaagcaaatgctgctatctttgaagtgcatcagatgatgcttgaggatgatgactataatgagtccattgaaaatattatccgtactcagaaagtcaatgccgaatatgcggttgcatcgacaagcgataatttttctaccatgttttcgtccatggatgacgactacatgaaagaacgtgctgcagacgtaaaagatatttctgagagaatcctttccctgcttgcaggcggagaaaaaggcaaagtagtgacggatgaaccggtaattattgtggcagatgaccttgcaccgtcagaaaccgtacagttagaaaaagataaagtgctttcttttgtaaccgtgcatggttcggttaattcgcataccgcaattcttgcaagaaccatggcaattccggctttaattggaacagagatgcctctggatgaacgtgtcgacggaaaatttgcagtagtagacggagtaaatggaaaaatctatgtagagccggatgaagagacacttgcagaattaaaagaacgccagagagaagagttagaaaagaaagaactgctcttacagctcaaaggaaaagaaaatattacacttgatggaaagaaaatcatgctgtatgctaatattggaaacataaaagatttagcaactgtcgtacagaatgatgcaggtggaatcggacttttcagaagtgaatttatttatctggaaaaagaagattatccgactgaagaagaacagtttaagatttataagactgcagttgagacaatggcaggaaaacgtgtgattatccgtacgttagatatcggcgcggataaacagtgtgattatttcaaaatggaaaaggaagaaaatccggcactgggatatcgtgcaatccgtatctgcctgacccagaccgaaattttcaagacacagcttcgtgcgctgtttcgtgcaagtgcttatggaaatcttgcgattatgtacccgatgattacaagtctttgggaagtaaaacgaattaaagaaatcgtagaagaagtaaaagcagaactaacagcagaagaaattgaatttggaaatccacagcagggaattatgattgagacaccagcagccgttatggtgagcggggagcttgcaaaagaagtcgatttctttagtattggaacaaacgatttaacacagtatacacttgcaattgaccgtcagaatccgaaattggatctgttttataatgcacatcatccagctgtgctttctatgattaagatgactgtggaaaatgcacacaaagcaggaatctgggcaggaatctgtggagaacttggagcagatacctctttgacaaaagattttctggctatgggtgtagatgaactgtctgtatcaccgggaagcatccttccgattcgaaaaatcattcttgagacaaatgttgaagaatataagagaggaaattatgctgacggagaaacgttatgaagtaatactgaaatgtctgaatgagaaaaacagtattaccgttacagaattaaaagagttacttggaatttcagaatcaacaataagaagggatttaactgcactggataaagccggaaaactggtaaaagtatttgggggagcagttgcagtggattccggatttacaaccgttgagccctctgtggctcagaaatcaggtgtaaataaagaagaaaaaagccggattgcgcagtatgcagcatctttgatttcaccaaatgagtttgtttacttagatgccggaacaacaaccggacgaatgattgaatacatcacagaaaagagcgcagtgtttgtgaccaatgctgtcagtcatgcacagcgtctggcagcagagggattcaaagttcatctgattggcggagaattaaaagggacaaccgaagctgtggtaggaaatcaggcaatcttaaatattcagagactgcatttttcaaaagccttttttggtgtaaatggaatcagcttaagggcagggttcagcactccggattacagtgaagcaatggtaaaacagaccgcactgcatcaggcgagaattgcttatgtgcttgcagattactcaaaatttggaaatgtcagttccgtgacctttgcaaatttagaagaagcggatgtgttgactgacagaaaaccaccggaaagcttttccggatgtaaaaatattctggttgtgtaaatttacgttgtttttacaacccaaatcagttattatattaagtagaagaattaattaagaaaaagatttgggggtggtaaaaaatggagcgttatgatgtatttcatgatattcttgtgaatttatttcaggagattatggatatcgaagagaaagccctgattaccgctgaatttaaaaatatatccgtgaatgatatgcatatcattgaggcaattggaacaggagaaccgaaaaatatgtcaactgtggcaaagctgatgtccgtcacggttggaacacttacaattgcgattaataatctggtaaaaaaaggttatgtaagcagagtcagaagtgaagaggacagaagagtcgtgttgattttcctgactgaaaaaggaaaacgggcgtatcagcatcatcgggagtttcatgatggaatggtaaaagcactggtggaaggtctggatgaagggcagcagaagattcttgtgaaatctttactgaatttgagaacgttttttgattcttataaaaaagattgagtgtacagaaattttgtacacccaatctttttttgctttttaatagttttccagtacatacttttctataaccggaaacggagcaggtccggtttctaatacaaatcggtgaaattcttttttatcaaatttatcaccggcttttttttcagccaagtctcttaaatccataaaattcagatatcccagatagtattttaaataattggcaggattttcaatgatgtattggtaaatttccttgcaggtatcatcagaagcaatgccgaatccatgcaaagactgtgtaacctgagctaaggtccagccgtattcatggattttaatatcgagtagagaatacaggcagagactgatggagcggttttgccataaaagctgtaaaagttctggttcgactttaaaataggaggcggcatagccgtaggaaatggattcgacataagtcgcccagccttcaatatagccactgcatccgagcagatttcggataggagcaggattttgatttccataatataaagtttgatagaggtgtcccggaaagccttcatgggcaagtgtggtaaagagttcggcaggatttacctgtgaacttcgattgatataaatggtatttggacttaaggtgtccgcaggcggagtcagataaaaggcgggactggaaaattcttccattgaggtgggaacatatttcacttcgtacttgggactgtctaaatcaggaaaatccgtctgcatggctttgtttagataggaaagcatttcttctggtgtggcagaaagagaaaaaacagaaagattttgtgcaagggatggattttgggagagcagagtctgcatctggcggtaatcaagggcaagctgggtaaaaagccgttcttcgatttcgttggtactgcgaaaatctccgacctgactttgaatcaggtagtgataataggcagtaccatctggaaaaccggcaagccctctgtcatttttttcactgccttttagagcagaaagcttttctgaaagtgattgataggaaggaatcacgcaggtatggattaatttttcatggaggcttagataggaatctgcctgttttttggtaagtgtatcagtattttgaagtgaattaatcttatctttaaaagcagaagcaagataatccgaggagagcatggtctgacactgtgtaagcaggcgctccaaagaagcatcactcataaagagcccacgcttcgctttttgagattcaaattctgccagttcgttataatagtcggggaggcaggagagtagagaaaaatagtctttgatatcgtttcctgtgcggaaggtgtattcggcaagcagaatcggaagctgggaagaaattccgagatgaggacttaagggttcttgaagccagaaaaagttttcaccggaaagctgcgtggaaaattccagagagagaatatcataagtcagctggttttctttggaaagtttttgatagtgaaagtttttcaggcgtttttgattggattttaatttagaaaatgaattagaatgagctttttcgttcattgagccaagactgattttataatccttgattccaaatttctcgggatgtgcaagcgtataatgcagatttaaagtattagaagaaagttcggaagtaaaaatagaatcggtaaagtgttcaaactgtttgttttccagagtgggttcgatttttttcaaaaagatgatagaaaaaacaagaaagaagcaaaaaatgaaaatcaagattcgatatttgttatgtaggaaatttttcaaagaactgtcctcttaaagcttgagaattctttattagtttatgaaaaaaatgaaagagtatgaatgcagataagcattcccccgcttcaagtgcgcagatcgcgaagcgactgcgttcatgagcaagtagcgaagcggattgcgaatgtctgctttaccaatacagacaaattggaaaaagcctctgctggaaaaaggcagagacttgtgataagctaatgaagaagtgaactctaaaataagggaggaaatgcaaggtgaaaaagaagatgctggttttatttctggcagtgggaatgatacttggaggatgccagaacacacaggaaaaaccacagaccggaaagggagaagaaacatcacgggacgaaacggaagacacgccagaagaagagaagaattatgatgtaaaactgtcgaagaacttatatgattttgaatttgcaataaatgatacggtttttcatttgccgcaaacgctggatgagtggaaggagactggatggtcttatgagcgtgccgagtcggaagaaatgctggatggtgattcgtttttggagggggagacattaaagaacgaggaaaaagaactgattgtggatattgtgaatctggatggagaaaaacagcagcttggcgcatgcagtgttgggggagcgacactggaaaatacggataaggataatatggtttatcaactgcctggaaaaatcacagtgggagaatccacgttagatgatgttttagatgcgtatggagacccggatgaccggtatgaggaaaaagactgggtttatgtaacctatgaatatggaatttataagaaagcggatttggtatttgacattgaagatgaagtccttgaaaaagcagtgctgaaaaattacagggattctgaaccggaagaaaccagcaaagacgtgccaaaagaagtgagtgactatcaggctccggaagctttttcagagaatccactggattttatcgtgcagtttgatggagatttttatcagcttccggcaccggtttctgaatttatcaaaaacggatggaaaatcgatgaagaaggttccgatacctcggtaaaggcaggacgccatggctatgtaacattggaaaaagacggacagacgttatatggtgttgtgaataattactctaagagtgcagttccgattaaaaatagttttcttaccaatctgcatggagattttgatgtgacaaaagtgccgattcagatttatagagggattacgcttggaatgaatgaagaaagtatgaaagaagcgttatcggatgcaaaatatgaaacaaaagaggacgaagaaggagtttcttattatctttatgcagatgaagaaaaacgggattatgtgcggatttttgtagataaaaatttaaaattggtgcgtgaaattgagctgagtaacagtccggaaggactggaagagaaaatgttatcggaagaggatgaaaaaagtgtagaggcttctgcaatgtcaggcagtgatactcttccggaacaggaataaatttaagaaagaagagataacaggtatggaagaaaaaatttatgatatggtaattatcggagcaggtccggcaggaatgagtgcggcggtttatgcaaagcgtgcagagctttctgtgctggtgattgagagagattttgcaagcggtggacagattgtaaaaacctatgaggtggataactatctggggctgccgggaatcggcggatatgagctgggtgaaaaattccgggaacacgtagataaatttgaagttccgtttgtaagagataaagtacaggaaattcagttagatggaaagcttaaaaaagtaatcacgagaaagggaggatatcttgctaagactgtgatttttgcaggaggatcaagcccgaggctgcttgagattcctggagaagaagaatttcagggaatgggtgtttcctattgtgcaacctgtgacggtgcatttttcagagagcgggtgacagcagtaatcggaggcggagattcagcagtggaagatgtgattttcctttcacgcatttgtaaaaaagtgtacatgattcacaggagagattcgttaaaagcatccaaatctctgcagtcagtccttgataaacttgaaaatgttgagattttgtgggatactgtagcagaagcgataaagggaaacagtgaggtagaaacacttcagataaagaatcagaagactcaggaaaaacgtgagctttcggtagatggagtgtttattgcagttggagcagttccgaataccaaagaatttcagaatttgattcaactcgacgaagcaggttatatcgcagcggaggaagattgtagaaccaatgttgcgggaatttatgcagcaggagatatccggacaaaggcactgcgccaggtggtgacagcggtttcagatggcgcaaatgcagtttacagtgcgcagaaatatctatctgaacttgcataagggacagggaaacacataataacacatggcaaaaagaggattaaggaggaactttttgatgaaaaacacaaaagtactggtagaagaactggaacagggaaaatatgacagcgttctcttagatttatatgtggatgcggaaaaactggactatcagagaaaacgttatattgagacaatcaaaaaatatgaggaaacattcggagaaggcgaagtggaaatctatagcgctccgggaagaagtgaagtaggtggaaaccatacagaccatcaacatggaatggtacttgcaacttctatcaatctggatgcactcgcagtagtgggagcttcaaaagacgaaaatattcatgtaatgtctgaaggatatgacatggtggatgttgagattgatgatttagaagccagacatgaagaagaaggaacaactgctgctttaatccgtggtgtaaccgcagatttaaaaggaaagggttatgaagtaaaaggatttcaggcttacgtaaccagcgatgtattgattggtgcaggactttcatcctcagcagcttttgaagtaatcgtgggaaccattctttccggtatgtttaatgacgaaaaaattgacccggtagtgattgcacagtccggtcagtttgcagaaaatgtatactttggaaagccatgcggactgatggaccagatggcatgttcagttggtggtatgattcatattgattttaaaaatccggaagagccggtagtagaaaaagtaccatctgattttgaagcttatcagtacagcttatgtattgtagatacaaaagcatctcatgcagatttgacagatgattatgcacagattccggcagatatgaaaaaagtagcgaaattctttaaaaagaatttcttaagagaagttctggaagaagaattttataaccagatttctgcaatgcgtggtctgttaggagaccgtccggtgcttcgtgcgattcattttatggaagaagaaaccagagtacagaaagaagtggattctttaaaagcaggagacttcaaaggatttcttgaactggtaaaagaatccggtaactcttcttttaaatatcttcagaatgtatatactacaaatgacttaaatcagcaggccgtttctgttgcactcgcaggaagtgagagaattttaggaaaacatggcgtgtgcagagtacatggtggtggatttgccggaacaattcaggcattcgtagaaaatgatttcgtagaagagtataagagaagaatggacaaagtatttggacatggttcttgtcaggtattaaaagtacgtcaaaaaggcggggtaaaagttctcggataagaaatataattttcagaatattcacggaaaaaaagtgcacaaaagattttaaaaagtggtcaaaatcacgaaaaatacggaaaaagttatccacattttattgtggataaaaggctgtaaaatcaagttatccacaaagttatccacattcgtgtggaaaatgtggataacttttttgatttacataagattcgagccaaacagacgttttgtgcataagttataaaagtggatttgtggataactttgtggacaaaaaaatcacgagagtcaaattcaattattggggaataaacacttaaattgtatgaaattatgagaaaactaaatataatatcagaaaataatgaaatcctataaaacttcataaaggacacaaaaaaacaccgtccccgcagtatcaagtctctgcaaaaacagtgcttttagtgcgccttcagggactcgaaccctggacaaatagattaagagtctactgctctaccaactgagctaaaagcgcattcgttattccatttctttaatgcaaaacttattatactggaataaacgaaaaaatgcaaggggaatttattgtattttttgtttttatttaaaaacatgatgccaaggtcaaaaagttcaaaaatcgttcgggcttgcacgacaagatttttgactttggggtcgcctaaacatgaaaatgtagcgatttacgtagtaaatcagcggaatttgaatgtttatagaattgcgagagctgttttacagcgaagcaattcgtaggcatcaattagagttttttagcgttttttcttcaaatattgcagcgatttctcggcttccatggcggccttcataattcgtgccgcctgtgttcccatttttcgattggtgtaagcccagatagagagtgtggtctgtaaagatttcttttttgacaaagcaaagattcctttttatttaagtatatgaaaagaaatcttatcttgctgcaattaatttacagattggatttccctcagaagagaatttttcttcgtattcggtcataatattaccgacattcattttttcgttgtgatggaggtcgtaagtccattcgaccagatgccatttgctttcattgacttcctctaaagagaaatcaaagagcgggcgattgtcggtcttaaattcaatgactccgtctgattttaagattgcatcatagcgttctaaaaactgacgtgaagtaagacggcgtttagcatggcgttcttttggccatgggtctgaaaagttcagataaattttatcgacttcccctgcgtcaaaaatgagtggaagttctcttgcgtccatgcggacaaagtaaacatttggaagagtgtttccattttcggcacgttcttctattttttgaagagcacgtagaagaacactgtcgtacatttcaaatccgatatagttgatatccggattctgggaagcaagatccattaaaaaacgtccctttcccattccaacttcaatgtgaattggatgattgtttttaaagatttcattccaacgacctttattttgtgccggttcgtgaatgacataaggactgctttcgatggcatcttttgctcctggaatatttcttaaacgcatatttcgttccagcctttctatttatgtgattgatatctgatacagtatactgaatctgaaattgtttgtcaaagcctactcgtcaaaacggaagaaagatgtgggaaaatagacagaaaaggcaggaaaggtttagaaaaattgcataatttaatagaaactttatgaaaaaatctatggattttttctgaaaatagtgtatgataggagacaagtagtagaatatagttaaaaaatagtttaacttaagatttcacttaaaacaaggaggagcttgcatggatgatgtaattagtaagctggcagaaatagaattggctgcctccaaaataatggaaaatgtggtggaggagaaaaaaagcctttctttagaaaatgaagccaggataaaagcctttgatgatgaggtggacaaaaagacagaagaaaaattggaggggatacgaaaagggcttgaagtggatatggagcaggaactgcttttacagaaacagcagacggaggcaaccttaaaaaaaatggaagccggatacgaacagcgtgccgaggcaatggtgcaggagttatacgacaaaatattaaggatgtgatattatgggaactctgttatcttacagtggtctttcaacaaaaatccgagcgatgcagagccggctgatgacagaaaaacaatatcaggaaatcgcacagatggaatccgtgacacaggtagttgcatatttaaaaagacagcctggatttgcaaagctgtgggcggatctcgatgaaagcagtctgcatcgtggagagattgaaaaacttctgacccataccatccatcaaaattttgcgaagatttaccggttcgcaaatccatcgcagagaacctttatggatttgtattttaaacgatatgaaattgcggttatgaaggactgtctgagaaaaatctttgatggaagtggagatggacttgatttatcactgtttcaggatttctttgataaacattccaaattaaatttagagaaactgaccaaatcagcgacggttgaagaatttgtttctaatttaaaaggaacagagtattatgcaccgctttcaaggattggacaggagtatcatccattgttgtttgattatggaatggcgcttgaccagtattattttgcaaatatctggagaatgaaagataaactgtttaagaagagagatttagaagagattataaaggcttatggtaataaatttgatatgttaaatctgcagtggatttatcgttccaagaaatattaccacatggcaccggcagatatttatgcgttgctcagtccggtgcgttacaaactttcaacaaaagaaattacagaacttgtagaagctgtggatgaggaggagtttcgcagggtacttgatactacggcatataaaaagcattatccggaactgacacctgataagctggaagaatattataatttcagcatgaggacgattttagagacggaagcaagaaagtatccacattctgtaatcatgatatattcctacttttatcataaggagcatgaggtggatcggctgacaacagcaatcgagtgtatccgctatggtttggctccggctgagacattggaatatattcatagaaattaaaccggaggtagcagacatgattgagaaaatgaagttcttaagcattactggtccgaaggctgatattgaccgagtggttaaccaatatctggcaaaatatgagattcatctggaaaatgcaatggcacagctgaatcaggtacaaaacctgtctccttttatacagattaatccgtataaagaggtgcttgcaaaagcagaagaatttacgggacttcttggagaggaaaaacagctgaaattacgagatatctctttagaagaagccacggaattgattgacagacttggaagtgagctgtcggaaattaatgtaaagtgtgaagaagaaaacaaaaaacgaacgaaaatagtagaagatttaaatctggtcagtccgtttttaaaacttccaggcgatattgaccagctggtgcattatcgttttgtgcaggtgaggtttggaagaattgccagagaatactatgaaaagtttaaggcttatgtatatgatagtctggacacttggttttatccgtgccacgaagatgagtatgtgtggggtgtttattttgtgccgtggaccaggatggaagaagtcgatgcagttttttcttctctgcattttgaacgaatttatttaaagaaagattattactatggaactccacaggaaatctacgataagttaagggtagagttaaatgcagtagataagaaaattgcagaatataagagccaggcttctgaattgttgaaaaaagatgcagtatctgttttttctgcaaaagagaaattaagtgcactgtcggttaactttgatgtacgtaaagtggcggcctgcgtaaaagagcatcacgaaacgttttatattttatgcggatggatggcggaagaagattctatcgcatttgcaaaagaaattgaaaatgatgcaaatctgttttgtattattgaagatgataagtataacatcaatgttcaaccgcctacaaaactgaaaaatccgaagatatttaagccatttgaaatgtatattaagatgtatggacttcccgcctacaacgagatggacccaacaatctttgtggcaattacctattcctttatttttggggcgatgttcggagatgtcggacagggattattattagcaatcggtggactcatcctttataaagttaaaaacatggatttggcagcgattatcggctgtgcaggtgtgttctctacgatatttggttttatgtatggaagtttttttggatttgaggatttaatccccgccttgtggctgaaaccatcggaggcaatgctgttgataccgggtcttggaaatatgaatacggtattcgtagttgcaattgtatttggtatgttcctgattctgcttacgatgatatttaacattatcaatgcagtaagaagtcgagatatcgaaaatataattttcagccagaatgcaatctgtggattggtattttatggcgcattgaccgttacgattttactttatatcacaggacatgcacttccggcaacagtagtattagttgtaatgtttgtaattcctctgattttaattatgttaaaagagccgttgacccgtattgtggaaaagaaaacaccggcaattgagggcggaaaagcaatgtattttgttcaaagtttctttgagttgtttgaggtaatgttaagttatctctcgaatacactttctttcgtgcgtgtgggggcatttgcagtcagccatgccgcaatgatgggagttgtattgatgcttgcgggagcagagagcggaggcagtatcaactggctgattattattcttggaaatgcatttgtatgtgctatggaaggtctgattgtaggaattcaggttcttcgtctggaatattatgaaatgttcagccgcttttataagggcagtggacgtgaatttaagccatttttaaaaaatgtaaaaacaaatcattaagtaaaaacaaatcattaagtaaaaacagaagcgagagcaaggaggacttttattatgacaggtattattcaaattacaattgcagcagcattaattttaagcattattcttccatttggagcattttttcttggagagaaaaacagaaaacgttataaaacatctcttggggtgaattgtttctttttctttggaaccttacttgtggcaactgttgttatgcttggcggaacagtgacagcaaacgcagcatctgacgcagcagcatctggtcttgcaaccggtcttggctacatcggtgcagcactcgttaccggtctttccggtatcggttccggtattgcggtagcaagttcagcaagtgcagcacttggagcaatcagcgaagatggttctttatttggtaaatctatgattttcgtagccatggcagaaggtattgcactttatggtctgattatttctttcatgattttaggacgtcttggttaaattggactaaaaacagcggcaggatagaatgggaaaggagcgggcatttatgaaaatgtttttaatcagtgataatattgacacctacaccggtatgagactggcaggagtagagggtgttgtggtacatgagcgggaggaacttagaagggcactggaagatgctatcgcaaataaggaaaatggcattattcttctgactgagaagtttggccgtgaatttccggaaatcattgatgatgtgcgtctgaaccatcgcctgccgcttcttgttgagattccggacagacatggtaccggaagagcagaagattttattttatcttatgtaaatgaagcaatcggtctaaaattataaatgattcagaaataagaaggtgatggacatgacaacggaagaaaaactgcagcatttttatgatgtatcgatggagagtgccagggaagaagcacagaaggcacttgaagaatatagaagggcacttgatgatatgtttgaagaacataaaaaagaaaaagaaaaaagtgccgagcttcgtctgaaactggaaacggaaaatgcaaagcgtgaaattaataaagcattatctgcagagcagcttcacattaaacgaaaactgtcaaagaaacagcaggagttaagagaaaaaatttttattgatctgcaggcaaagctggaaatttttcgtaagagcagtgattatccaaagtggcttgaggaaaagataaaagaagcacaaaacattgcagattcagatgagattcagatttatttatcaaaaatagatgaaaatttaaaagaaagtatagaggcagaaacagggatttccattcaactttcagaagaaccgtttatgggaggaatgagagcagtgattcctgcgaagaatatactgattgaccagacatttttaacaatgtttgaaagtgaaaaagaagaatttaattttgacggagggctgctaaatgagtagaacaggaatcatatatggaattaatggccccgtcatttacctgaaaggaaataccggatttaagatgtccgaaatggtttatgtgggagaagaacatctggtaggagaggtcattgcgctgacaaaagatacaacgactgttcaggtctttgaggagacaagtggattaaaacccggagaaacggtaactgcaaccggagatgctatttcagtcacattaggacctggaattttagacaatatttttgatggtattcagcgtccgctttctgttattgcagaacagtccggaaaatatatttccagagggatgcaggttgattcgctggatacagagaaaaaatggaatgtaaaatttctggtaaaagagggtgatgaagtccacggaggaaccatttttgcacagacacaggaaacggcttcgattatgcataagtccatggtacctccgaaagtagaaggaaagattaagaaaattcttccaaatggggaatatagtgtaagcgaaatccttgcggtagtggaacaaacagacggaagtgaatatccattgaagcttgcccagaaatggccgattcgtattccgagaccgacaagcaaacgatatccggcaacggttccgcttgtcaccggacagcgaattttggatacgttgtttccgattgcaaaaggcggaacagcggcagtacctggaggatttggaacaggaaagacgatgacccagcatcagattgcaaagtggtccgatgcagacattattgtatatattggatgtggagaacgtggaaatgaaatgactcaggttttggaggatttctcaaaactgcatgacccaaaaacgggaaatgcactgatggcacgtaccaccctgattgcgaacacttcaaacatgccggttgcagcacgtgaagcttctatttataccggaatcacgcttgctgaatattaccgtgatatgggatacgatgtggcaatcatggcggattccacttcaagatgggcagaggcacttcgagagctgtccggacgactggaagaaatgccggcagaggaggggttccctgcttatctggcatcaagactgtctgcattctatgaaagagccggcatgatgcagaacttaaatggaacagaaggttcggtatcaattatcggagcggtttctcctcagggcggtgacttctctgaaccggttacacaaaatacaaaacgatttgtgcgctgtttctggggattggataaatcccttgcttatgcaagacactttccggcaatccactggctgaccagttacagtgagtatttaaatgatttggcacactggtatggagaacatgtttcacccaaatttgtggatgacagaaataaattaatggcaattttgaatcaggaaagcagtctgatggaaattgtaaaattgattggtagtgatgtacttccggacgaccagaagctgacccttgagattgcaagagtgattcgtcttggatttttacagcagaatgcatttcatccggatgatacctgtgtttctctggagaagcagtttaagatgatggaaattattttgtatttaaatcaaaaatgcagaagtctgattgcaatggggatgccgatgtctgtacttcgtcgggaaaacatttttgaaaaagtaatctctattaaatatgatgtaccaaacgataagttagagatgatggatgattatcaaaaagcagtagatgatttctatgatacagtcatggaaaagaatggataaggagggaacggaatggcaatcgaatatcttggcttaagtgaaatcaacggccctctggttgtgctcgaaggggtgcaggatgcagcctttgatgaaattgtagaatttaaagtagatgacggtacaaaaaaaatcgggcgtattgtagaaatttatgaggataaagctgtcattcaggtatttgaaggaacagaaaacatgtctctgttaaacacccatacaaaattgaccggacatccgatggaagtagaattatctccggacatccttgggcgaacctttaacggaatcggaaaaccaattgacgatcttggcccggtgattccggaaatgaaattaaatattaatggtctgccgttaaatccggtcaaacgagagtatccgagaaacttcattcagacaggtatctctgcgattgatggtttgacaaccctgattcgtggacagaaacttccgattttctcaggaaacggacttccacatgatcagcttgcagcacagattgtaaaacaggcttctcttggtggggacagtgatgagaaatttgcaattgtatttgcggcaatgggcgtaaaatatgatgtagcagaatttttccgcagaacttttgaggagagcggtgttgcggaccacgtagtcatgtatctgaatctggcaaatgacccagtagtagagcgattgattacaccaaaggttgcacttactgcggcagagtatctggcatttgagaaaggcatgcacattctggtcattcttactgatattacttcttttgcggaagcgatgcgagaggtttcttcttcaaaaggagagattccatcaagaaaaggttatccgggttatttgtacagtgaactggcaaccctttatgaacgtgcaggaattgtaagaggtggaacaggttcggttacacagattccgattcttacaatgccaaatgatgatattacgcatccaatccctgacttaaccgggtatattacagaaggtcagattgtactcgagcgtcagcttcatgggcaggcaatttatccgccgattaatgtccttccatccctgtctcgtctgatgaaggatggtatcggtgaaggttatacgagagaagaccatcaggatgtagcaaaccagctgttttcctgttatgcaaaagtaggagatgccagagcacttgcatctgttattggtgaagatgaactttcaccgctcgataaaaaatatctggaatttggaaatgcatttgaacaacagtttgtcggtcagggaccggatgaaaacagaagtattcaggaaaccctggatctcggatggaaactgcttggaatgattccaagagatgagctcgaccgtattgacacgaagatactggataaatactatcatccggaagagaatgcataaagaagaggtgatgttatggatccgaatacctttccaaccaaaggaaatctgatactggcaaaaaattctctcgctttatccaaacagggctttgatttgatggacaaaaaaagaaatattttaattaaagaactgatggagttagtagaccaggcaaaagatatccagtcacagattgatgtcacatttcgtacggcttattcggcacttcagagagcaaatttggatattggaatcagctatgtacaggaaatttcaagaactgttccggtggaagattcgattcagattaagacccgaagtgttatgggaacagagattccattagttcaggcgaatgagtcatccaatgcgccaacttatgcttattatggaacaaaggcttctcttgatgaagcaaagtcagcgtttgaaaaagtaaaacagctgacgattcgtctttctgcggtggaaaatgcagcctatcgtctggcaattaatattaagaaaacccagaaaagagccaatgcgctgaagaatatcacaattccgaaatatgaagaattgacaaaatccatcagcaatgcactcgaagaaaaagagagagaagaatttacaaggttaaaagtaattaaacgaatgcagggaaaataaaaaacataatttttatagaagagaagttgttaaaagaggaattttaacaacttctttttttaccaaaatttaacatgagacagattttatattttactttgcttttttatactgagactcgtaaatgagagcaatactaaaaaagataaaaattataaagcaaggagaatttaattatgaagaaaaaattagcagcattattaattacaggaattatggcagcagcaatgacagcatgtggaagcagtaattcaggaacagacaacagtggaagtacagatggaactgcaaaaacagagagcagtgccgatgcgggcagtgactgggataatacaagagacatcacagttgtatcaagagaagatggttctggtacaagaggggctttcgtagaattattcggaattgaagaagaagtaaacggagaaaaagtagatatgacaacagaagaagcaaatatcacaaacagtacttctgttatgatgtctaccgtggcacaggatgaatacgcaattggttatatctcgctcggttctttagatgattccgtaaaagcagttaaagttgatggaagcgaagcaacagcagaaaacatcaaaaatggaagttataaaatttccagaccgtttaacattgcaacaaaagaggatttaagtgacgcagcacaggattttgaagactttattttaagtacagaaggacagaaagtagtggaagacaacaaatacatccctcttgatgatgtgagtgattataaatcaaatggagcaagcggaaaagttgttgttgcaggttcttcttctgtatctcctgtaatggaaaaattaaaagaagcttatcaggcagttaacagtgatgtagaagtagaaatccagacaagtgattctacaacaggtatgcagaatgcaattgatggtgtatgtgatatcggaatggcttccagagaattaaaagattctgaaaaagaagcaggtctgacaccaactgttattgcaatggatggtattgcagtagtcgtaaacaatgataacccgactgatgaactgagttctgatcaggtaaaatccatctttacaggtgatgtgcttacatgggatgaggcgcttcagtaaagaagacttaagaaagaatcagtagcctgaagaaggttaaaagggtgaacagaatgaaaaaatataaagaacaggtgatgcatgcggtgttttttatcgccgcatgtgcatccgtacttgcagtcgctttgatttgtctgtttttgtttgtaaacggaattccggcgatgaaagaaattggaattttcaagtttcttttaggaacgatgtggaaaccgggaaataatatttacggaatccttccgatgattatgggaagtatttatgtaaccgcaggtgcaattttaatcggagttccgattggaattttaacttctgtatttatggcttcctactgtccaaaaaaagtatatcgtttttttaaatcggcaattgacttattggccggaatcccatcggttgtatatggtttctttggtttaatgatgttagttccactgattcgcaatttattccacaaaggaaacggaagcagtattttaagtgcttctatcctgcttggaatcatgattcttccgacgattatcggggtgacggaatctgcaatccgtgcagtaccttccaattactatgaaggttctctggcacttggcgcaacaaaagaaagaagtctgtttttcgttgtgcttccggctgccaaatccggtctgattgcaggtgtggtacttggaatcggtcgtgcaatcggtgaaactatggcagttgtaatggtagcaggaaatcaggcacgtatgcctgccggaatcttaagaggtgtccgaaccatgacatcaaacattgtactggaaatgggatatgcagcagatttacacagagaagcattaatcgcaacaggcgtggtattatttgtatttatcttaattattaacttctgcgttgccagattaaataagggggaaagtggtcatgcataaaaaagaacatcagggagcgaaaatcagtgccggtattttaaaaggtctggtctttgcatcagccgctttaacctttttagtcttatttttcctgattgtctatattttggttcatggaattccgaatctgacaccacagttatttgcatggaaatatacaagtgaaaatgcttccatgcttccatctatcattaatacgttaattattgtgatattatcactggtcattgcagtgccgcttggtattttttccgcaatctaccttgtggaatatgcaaaaagaggaaataaatttgtaaaaattattcgtctgacgacagagacactttccggaattccatctatcgtatatggtctgttcggtgcattgttttttgtaaccgcattaaaatggggttattctttacttgcaggtgctctgacattgtcaattatgattcttccgctgattatgagaacgacggaagaagcattaaaatccgttccggattcctttcgtgaaggaagtttcggacttggagcaggaaaactcagaacggtatttcaaattgtacttccaagtgcaattcccggtattttagccggtgttattcttgcagtcggacgaatcattggagaaacagcagctttgatttataccgcaggtgcggtggcagaagtgccgtcgagcatcatgggttctggttcaactttagcagtacacatgtacaatctttccagagaaggtttatatatgaatcaggcgtatgcagtatccgttgtcctgttaatttttgttctgctgattaactggggttccggaaaaatagcaaagaaacttacgaaagggaaagaataacggaaatggaattgaaaaaaaatcagaaaatagaagtctcaaatctggatttgtattattcagattttaaggcattaaaaaatataaatattaagattccgcaaaatgaaattacagcatttatcggaccgtccggatgtggaaaatcgacgcttttgaaatcattaaatcgtatgaatgatttggtagaaggatgccggattgatggacaggttttgctggatggagaagatatttacggaaggatggatgtcaatctgcttagaaaacgtgtcggaatggtatttcagaagccaaatccatttccaatgagtatttacgataacattgcttatggaccgcgcactcatggaatccgttccaaatccaaactggatgatatcgtagaaaaatccctgcgtgatgctgccatctgggaagagacaaagaatcgtttaaaatccaatgcacttggaatgtccggtggacaacagcagagactttgcattgcaagagcacttgcagttcagccggaagtacttttaatggacgagccgaccagtgcccttgatccaatttcaacttccaaaatcgaagaactggcaatggaattaaagaaagagtatacaattgtaatggttacgcataacatgcagcaggcagcccgtatttctgataaaactgcatttttccttttaggggaaatcgtagaatttggtgaaacagaacaattattctctatgccgaaagataagagaacagaggattatattacagggaggtttggttgatatgcgtacaagatttgaccagcaattggaaaaactgcatgtggaattaattaaaatgggaagtttatgcgagcaggcaatcacactggctgcgtcttctttagaagttcaggaagagaatactttgcataaagtggcagcacttgagagtgaagtagatgcaaaagaaagagaaattgaagatatctgtatgagacttctgcttcagcaacagccggtagcaagagatttacgtgttatctcggctgccttaaaactgatttctgatttggaaagaatcggcgaccaggcggcagatatttctgacttgactccttatattgtaaacagcagtattgcgagtaaagttcagattcatgatatggcaaaggcaacgattgacatggtaacaaaaagcattgatgcgtttgtaaaaaatgatttggagcttgcagaaaaagttattgaatcagatgatatcgtagatgatttatttaataaaataagagaagaactgattcaggaaattcagggaaaaaacaatgacccaagagcggcaattgatattttaatggcagcaaaatattttgagagaattggcgaccacgcagttaatgttgcagaatgggtacagtattctattaccggtgtgcataagagtaatgaacatcatatagcagacagataggaatgaggtgaaagggttggtctatctggtagaggatgatgaaaatataagagaactggtcacatacacattaaacagtcaggggattgaaacagaaagctttgaacgcccatctaaattttggaaggcaatgcagcaggagattccatccctgtttttgcttgatattatgctgccggaagaggatggacttagtattttgaagaaaattaaaaatacaagccagaccaaaaaattgcctgttattatgctgactgcaaagggaagcgaatatgatacagtattaggtctcgacagtggagcggatgattatatcgcaaagccgtttcgtatgatggaactgatttcacgagtgcgtgctgcattaaggcgaagcgatccggaggaacaggaaagggtcaaagaatatcagtttggaaaaatctatgtttgtccatccagacatattgtgagtgtggacggaaaagaaatttcacttactttaaaagaatttgaactgctgtgcgtactgctttctgaacaggaaactgtattttcaaggtcaaaattgttagaccgtatctggggctatgaatttgatggggaaagcagaacggtagatgttcatgtgcggacactcaggcaaaagctgggagatgccggagactgtattaaaacagtaagaggagtaggatataagataggaggaaaagcttcatgacaaaacggattttccgctcaattatgctggtttctgcagtctgcatggtgacaggactggcatttcttatgggcgttttatatcatttttttgggaatcaattagaaaaagaattaaaagcagaagcatcttatctggaacttgcagtagaggaaaatggagagagtgtacttgagaagcttccaaaaaattcggcaagggtgacctggattgcggaggatggaacggttatttttgataataaagcagacgcttttgatatgtcgaatcacaatgacagggaagaaattaaggatgcacagaaaaacggtgcaggaacttctgtcagacagtctgatacattaggagaaaagacggtctactatgcaaaacgtttgtctgataatagtatccttcgtatttcgagcgatcagtatacggtgattgctctgttaaaacagctgattctcccagctgtctgcgtgctggttcttatgatattattaggagcattttttgcatcgagactttccaaacatatcgtaacaccattaaatgagctggatttggaacatccggatgaaattgatacttatgatgaaatggctccatttattacaaagattaataaacagcagaagaccattcagaaacagctttcggatgcaaaacgacagcagaaagaatttcagattatcacaaagcagatgcaggagggacttcttgtcatcgatacacagacagatttgctttccagtaatgccagtgcactggaacttttagatgccggacaggtaaaagataaagaaagtgtgctgtcactgaatcgtagtgaagcatttgagaagacaatagacaaagtcttacgtggagaacatgtagagtccgtattaaatttgggagaacgttactgccaggtttgtgcaaatccggtatttgacaaagaaacgatagcaggtgcagtgattcttttaattgatgtgactgaaaaaatgcagagagattctttaagacgggaatttacagcaaatgtctctcatgaattaaagactccgttgacttcgatttcaggctttgcagaaatcattcaaagtggttttgtaaaacaggaagatgttcggaagtttgcaggaaagatatttgatgagacacagagactggttaccttagtggatgatattataaaaatttctcagctggatgaaaattgtcagccgtatcagagagagaaagtagatatctataatctggctaaagatgtattgagcaggcttcaggaatctgctaataaagcacaggttcagttgaatatggaaggtgaacatgcagaacttgaaaccgtactgccgattttagatgaaattgtttctaatctgtgtgataatgcgattaaatacaataaaaaaggcggaagtgttaccgttacggtattaaatacaagaaatcagatatgcctgtctgtctgtgataccggaattggaatcacagcggcggaaaagagcagagtatttgaacgattttatcgtgtggataaaagtcattcaaaagaaattggtggaaccggtcttggactttcgattgtaaaacacggtgctgcttatctgggagcaaaagtagaactggaaagtaccattaataagggaagtacattccgtctgatttggcaaaaataaaagaaaaagaccttttgaacattgttcagaggtcttttttgaattgaaaattagtattttgaattttattttgaattagaaattactgcatcatacctgcaagtacctgatttaccagtttgccatctgcaattccttttacttttggcatcaggactttcatgatgcgtcctttatcttttccggttggtgtttcaatttcaagttcttttaaaactccatcgattactgttttgatttcgtcttcatttaacatttttggtgcaaattcttcgtatacggcgatgcgtttgctgcattcttcgataatatcagttctgtcagcaggagtcatttctaaggtttcttttgtctgtttgatttcttttaagacaacttcattttcttctgcttctgttaaatcttctcttttatcaattgctttgtttttcagtgcggataagagcatggacagagagtcttttctttctttgtcttttgctttcatcgcagctaccattgcttttcttacttcatctgctttactcatagtggttatcgctccttttcaaaatattttctaatttaagagtataacactctgaaaaaaagaatgaaacccctaattagcggattctccataaattccaatgaaaataggaagcgaggagacggatgacgacagtcacaatcaagccgataattgcaccggcggcttcaccgacagagtttcggcatatcacacaggcagcacctccggcaatggaagcgcaggcataaatttcccgaaccagaatataaggggtttcgcctgccatgatatcacgaactacaccacccccgaccccggtcaatactccgacaaaaacaaagaaaaaggcattgtctttgttcataacatttgcggcagcctgaatcccgactacagtaaagattccaagtccgagcgtatcacataaaagcatgatggtatcgtaatatttacttttaaacccagaatctaagatagaaggattggtgtagacaattgtaaacagcagggtagcagtcagcaccgaaaataacacatataccggtttggaaaatgcagcaggaggagtgacgccgagaataatatcacgcatcattccgccaccgacggcggtagtcgctcctaaaatgtttacgccaaaaatatccatttttttttcgatggcgatcattgcacctgaagatgcaaatgcaattgtgccgataatttcaagaataaaggtaaaagtatccatagatgtcctcccaacaaagacttttgtgagtgagaaaaagtctttgaaaaattgtagaataattaatattgtattagtacaacaaagcagtttcagtatagcataaagacgtaaaaaaaacatctttaaatggcacaaagtccgtgaattacggacgttaaaagatttgactttttatggattttttgttactctatttaagactataaagtgtaaaattgtgaagttggaaaggggaaaaatggagaaacataaaaatgggagctttacaagctcaattggttttgtattggcctgtgtaggttcagcagtcggtctgggaaatatctggatgtttccatatcgtcttggagagtatggcggagcagcatttttaattccgtatctgttttttattctgttgtttggatttgtcgggttatccgcagaatttgcatcaggaagaaaagtaggaacaggaacgcttggggtgtacgcttattgttttaaagaaagaaaacaggaaaaacttggaaaaattttaggctggattccgcttatgggttcacttggaattgcaatcggatattcgattattattggatgggtcttaagatatttaggtgcgtcagtaaccaataccgtgctgaaagaggattccgcagaattttttgccggagttaccgcatccatgaaaaacgttccgtggcatatgatgattgtggcgattacggttatcattttattagtaggagccgcatctcagattgaacgggcaaataaagtactgatgccgttattttttattttatttgcgggacttgcagtgcgtgtctttttcttagagggttcacatgagggataccgtttcttatttgtgccgaactggaaagcacttttaaatgtaaatacctgggttatggcgatgggacaggcatttttctcattgtcgattacaggttcaggaatgattgtgtatggttcttatctgccaaagaatgaggatattgtaaaatcttctttacagacacttatctttgatacaattgcggcactgcttgcagcgcttgctattatgccggcggtgtttgcctttggaattgagccatccgcaggaccatctttaatgtttattactttgccaaatgtatttaaacagatgccgatgggaagactattctcagttctcttcttcttatccgtctgctttgccggaattacttctctgattaatatgtttgaggcagtaattgagagctggcaaaatcgttttaaaatcgggagaacaaaatctgttttgctttgtggcgcaattacatttttaatcgggttattattggaagaagaaaccagagttggaaactggatggattttattaccattatcattgttccgtttggtgcagtactgggtgcaatttctatttattatgtattaggttttgataaaataaaagaagaactggaacttggaagaaagaagccacttccggtaatatttaaaccggtggcaaaatatgtgtatgttccgctttctatcattatctttattttgggattaatttataaaggtattggataattttgttgacaaaaattatcaattataaagttgccctttaattttgcctatgctataataggcgcagacagcaaatgaagaaagacagctgtggatactttgaaaacgaaaaataaaatttctactaaacaaaaggagagtacgtcatggatgcaaaagaatttgctttaaaacagcacgaggaatggagcggtaaaattgaagttgtcagccgtgcaaaactggagacaccagaagacctttctgtagcttatacaccaggtgttgcagaaccgtgcctgaaaattgcagaagatgttgatttatcttataaatatacaagacgtcataacatggtagctgttgtgacagacggaagcgcagttcttggactcggaaacattggaccggaagcaggtatgcctgttatggaaggaaaatgtgttttatttaaggcatttgctgatgtggatgctttcccgttatgtgtaagaagtaacgatgtagatgaaattgtaaatactgttcgtttactggctggaagttttggtggtgtcaatctggaagatatctccgctcctcgatgctttgaaattgaaagaaaattaaaagagtgctgtgatattccgattttccatgatgaccagcatggtacagcagttgtaacagcagcagcattaattaatgcgttaaaattgacaggaaagaaattggatgaagtaaaagttgttacttcaggtgctggtgcagcaggaatcgcaatcattaaactgttagtaagccttggattaaaacgagtaatcatgtgcgacagaaaaggtgcgatttatgaaggtcgtgagggcttaaatgcagaaaaacaggaaatggcaaaaatctgcaatctggataaagaaaaaggaagtcttgaagaagtaatcaaaggcgctgatgtatttatcggtgtatctgcgccgggtgcggtaacagaagaaatggtgaaatccatggctgaaaaaccaatcctcttcccgatggcaaatccggtaccggaaattatgcctgaccttgcgaaaaaagcaggtgcagcagttgtcggaacaggaagaagtgacttcccgaaccagattaataacgtacttgctttccctggaattttccgtggcgcattagatgtcagagcaaaagacattaacgatgagatgaaagttgcagcagcttatgcaatcgcaggactggttgatgagaaagatcttgcagaagattacattattccaaatccatttgataaacgagttgcaaaagtggtatctgaagcagttgcaaaagcagcaagagatactggtgtgaatcgtatctaatgattacagaattgcacgaactgtattacagtaaggcaattcgtggtatcatttgagtgaattatcagaatgaaatacaaaagagaactttacgtggacagaggcgcataaagttctctttttatttttttagaactttgctataatgagatgtgagttgcaaaagcaggtatataataattttgatagtacatagaaatcgaagggggaaatttatgaatcaggaagaacgggcaagactggaagagagacaacgccagaaaaaaatcagagaacgtcgtcgaaaaaaacaggttaggagacaaaaaatgttgctggctggcattattatgataattgttataataacagcaggggtaaatattgtaaaaaataaccgtaagaaagcagaacaggctgctgtgacaaaagcaaagcaggaaaaactggcaaaacagaaacaagaagaattagaaaaagaaaatacactgtctatgattgcggttggcgataatctgtatcacgatgctattttagaagaaggaaaaacagattcgggagcctggaattttgattttctgtatcaaaacgtaaaaaaagaaattgaagaggcggatctttcggcagtgaatcaggaaacagtttttgtgaataatcatgatgaagttgccggatatccggagtttgcttccccgcttgaaggtggagatgcgctgataaaagctggatttaacattgtgacacaggcaagtaatcatgcttatgataaaggaaaagccggaatcttaaattctgtaacattctggcgaaccagtcatccaaatgttactctgcttggaatccataaagatcagcaggatgaggagcgcaatcgtatacaggtagtagaaaagaaaaattttaaaattgcgatgatgaattatacatttggcttaaatgaggcaacccctcttccggaggatgaaagttattcgattgatgtatttgatgaagaacaggtcgcaaaagatattgaaaccgcaaagtcggaaagtgatgttgtaattgtatttttacataccggtgtggaagatacgacggatattgatgaggatacagaaaatcgaattgattttcttgccagtcagggtgttgatattacgatttgttcccatccacatgtaatacgtgcctttggcatgaaagaaagagcagatggcggtcagatgctggtgtattattcacttggaaattttgtgtctacgcaggaagcaattccggagttgttagaaggcatggcaaaatttacattgaagaaagatttagatacaggaaaagtaacggtttctgattattcaatgcagccacttgtcatgcactatgatactggaaagacaaactgtgcagtttataaactttcggattatacagaggaacttgccaaagcacatggaattcatgaatattctgaagaggaatttacgttagaaagtattcaggagttttttgctccatttctgactccccagacatttgcgtcgggaagccagaaaaatagtgactaattaatcgtcgcagtattgttctggtgaaaatggatagagacttttataggaatccagttcatcagaagagacaggagcacgataaatcagaccggtcatttctgtggtggcaagaccgtcaaagtcatgtctggagctgaactctacattgtatttatcagaaataaaatcaggtgaatgatttttaaaattagaattcatggcaggcatcctttctgctttcattgaaatttaaagtgagttcgtttatactttagtatatgtaaagaaatgaatttgtaagcaacaaaaacgaggaaagtaaaaatggcaaaacataaggacaaagaagtaaaaacaaacgcaatgagaattttggacaaaaacaaaattttttatgaaacaattaattatgagtgcgatgaatttatcgatgggcttcataccgcagaaaagaccggtgcaccagtggaacagtcttttaaaactctggtagcgcagggaaaaagcaaagagtattatgtgctggtcattccgattgcagaagaagtagatttaaagaaagcagcaaaagtgctgggcgaaaaatcaatcgaaatgattcatgtaaaagatattacaaaagtaacaggttatgttcgtggaggatgcagtccgcttggtatgaaaaagctatatccgacgattattcaggaaagtgccgaaacctttgacatgatttatgtcagtgggggaaggattgggtctacaataaaagtaaatccgcaggaactggcaagggtagtaaatgcgaaatttgcagattttatcgtttgttaagattaatctgtgagtcatgaaagataagatctacttcgctgatttgaatcttatcgttatcacaaagctgatattcttcctgaggagaaagtggtttaccgtttataaaagttccgtttttggaatttaaatccataatgaaaaagcaggcggcatcttttcggattctggcatgcagacggctgacagttggaatagagaggcagagaccggcaagttcaggatgttttccgataagcagaaattcttccgttaagaaaacggtgaggggctgtccattttcaaaaacagtcagagaggcagatggtgtttgggcagagttgtctggttgaagcagtactgtgtcggaagaacaggcgggagattgagggtttggcatttgaggcgtagaagcttcaaaatcagaagaaaaatttgagttggaagaacttggattagaagaaaaacctgaatcagaggagaaatctaaatcagaggagaaatctgaattagaagaggagtttgaatgggaaaagaagtctgaagcaaaattaaaaattgactcagacttctttttttgatgtcttgaagtaaggaaaaagataagaagagaacctccaccaagaagaataaaaagaaggaaattgaggatggcctgagaaatagaaatcagacgatagtgcaggcagaaatagatacagacaaaaaaggcggaaagtgaaagtaaaatcccaatcagccacccgacagaagttttttcgtgcaaggtctcttcttcaaaaaaggacgtcatgacgtcttgtgaaggggaatcttcatcatagggatggagattctgtttttgaaaaacatttgagtgatagaggttttgagcatcaggttctttagattttaattttgcaagtgcggtttttaagagagcaggacaaagtggtgactcaaggctgtctttgtacagtccatagcctaaaagtacggcattgttatcttcatggttaattttaggcagaagatattcggttaaagagataaaatctttatcagacgaagctggttcaagtggaaaacagcaaaaataaaaagaagattcaaaatcctgataaatgtaatcgggagaaagaagcaggaggtcagcgtcaagcagataatcctccatgcaggtaattgtatttaaaagtgcttcaaataaagctttcaagtcgttagaattgaatttttttgtttcatatatttgagacagactttgccgtgaagtaatttcatagtaaagagaagtttctccatcaatcagacgagggatgcatggtaacagtcctttaattgaattggaaaacagcatctttgcagggtaatcggataatgcctgttgattttcattttttaaaataagatagctgtgattgagttcacgtttataagaaatatccatattttttttatctcctgaataaaaattttagagttaaagttatttcattgcgagtcggtagctgagtgtggggatatggaatatcccggtgtgattttattgggaattgctaccggaaatattgcacaatgcctgagcttttttgattttttcaataaaaagaaccggttgtatcactttagaatgggatgtgcctttgatgtgccagtttaagttaaaaattggaaaacggaattgttcttcaaaggaaacaaggacttcatggttgcttccggaaacagaataaccacctgtttcccagtggattctgagatttgcagtagagagcccgtcttgattctttctgacagactgtatgcttccaagttcagaagcttcaagagatgcatttgtacggatgctatgatgaagtgttccaattattaaaaaaagagaggcaaaaataaccagtagaaataaaccgcttaaacaggcagcttctacggtataactgccacgaagttttaactttgtcatgtcaattcctccttaaaccgattgggaaaaaaacagattcaggaacatgccggccagtaaaaatggaataaaggggatggtttcagtgcggttttttttatgaaagaagaataaaaatcctgccacgaaaaaagaaagaaaaaaagcaccggataagactccgagtaattcccagaacccaatccagatgccaagggcaagcacaatcaatccgtcggccagaccgattgcaccgtttgaaatccagcataataataacagtgcagttccgggcagaacggaaagaaaaattgcgggaagggcgggaaaaccggaagtaagagaagtctgcattttggaaaaaatcggaattgaaatccactgatactgaatacagaaataaaagattccggttataagaaaaagtaaaattttccaaagggagacgcattggtctttgaaatcttccaatcccataaaagctaaaaaaaataagacagcgattttgctttgcatagatttaatgacctccatttcgttgtgagcatcgggaacatagatgtagattttgtagttcggatttcttgataagtcttacgtgacgggtcaatccgccacaagaagaactgctgtgataacggtttccgctttgcgtaatataaaaagtgttctggttagaagaggagcggacacagcgctcacagggatggtatttttctccataaacattgcgaagagaagaaagattggattttgaagtagttgtaacagaaagagaaagataagtacaatcggaaaaggtatgatagacaccttgataatcggtcacataaaccatttcttcggaatcagaagtatccatatccgtattgttggaatcatagccagtccatgcatgaacagaagatacgatggtaacaggaattggctgaagtggaatcagagcgacagggcttttgtataaaaaagaggcttttaaggtaatccgtccattttggtaagaggacatcaaaagagagatgccatttttatgtcccaaaatctggggcagagcttcttctttcagtgcgttggaaagctgagtttttgcataagcgatgcatagggcactggaaactgcgccgacaggagaagattcagtgtcagattcgcagtaagcatacattccgagttcccggctgctttggctaagagatgcttgaatgactgactgaatccgatataaatcaagaaataaaacaaggattacaatagccaggaagaagaatggaaagacaaatgcactttctacagtcaggcttgcagagggctgaagagagtatttttcctttcgtgttgattttaaatagtttgattttaaattaagcctgtcagtgctatttacagagtagtttatcttatccataaatcctcctggaatgtatatatcctcgaagtcttttgggatttgaccgaatcaaaaaagtttctggcttttaaccaattgacttgcgaatatccacttgacttttgtgagaatacatgagtgcaaaaagggttatcggttacatatcatacccgtaagtgcgtacagcactccaggttttctgttgcggacctgtaaaaattgtttctgtctccaggctttcaatgcaggaatccatgtaaaatgaagaacgttttggaagtgttcgaatattctgttcaatcatatccatgcatcgaaatgcctgtgtctgttcagaagaagaatacaaaagaagatgcagataattttgataattaagcccggaatgggagcgaatggtatcgctttggagaagagtgaaaatttgtccaatctgtgagagatttagctgccagctttcagtcgatttaattgccggaacactgcctccaagcatgagctgtcttacatcaagcaggctttcggcataagcccatccggcaataataagtgcttctgcgattgccatgccctctggaattaaaagaagggaacataaggcagcggcggtcatagctgcttcttctcgtttttgagggtcagtataaagatacacacaattggccgcttcacgaattgcaatcagccggtggacggttgcttttaggttttcttcatcggaagcacgaccaccgattatgtattcagcttcataacttagggcatgtccgtctttttcggtgatataatttccaagtttgtccataacataagcctgcattaataatttaccggaatcgctgttctgactttgaagagtgcccatgcctttttgaagtgtgcggtgagaaagtgtatctgtaagagaaatttctttttgggaaacctgccggtctgagggcagtaccagaccaaggatgccaagttcacgcaatcgttttaagatggcgataggattattggtttccgtaaatgcgggagggtgttcttctgcttctgtgacatcaaattccatgtctggtagtccttgttctttttgttcttcctgatttttaagggtagagtccgtctgttcaaggaaatctcttaaagaagagatggcttgtgttccaagttgatttttaacagcccgggagacctgccccataaaagaacgtgcattttcatccgtagaaagcacatacccggtgattgcacaactttgaatctggcatctggtaagacttgtttcgagtgtgggcttcataaaagattccatttgccggacgataaaggaaggattaacttgactgcctccgtagccggcatcaagatagaataaatcataagaatctaataaatccttatcatattgggcgaaaatagaataaataccggtatcggctgcatgcattgcctgaatccgtcctgcctgagttcgggcaagctgaatacccgagaggagaagagagagcaggatagaaaaaatcaggcacatcgtaatcgtcatacttcctctgcatttcttcacagataaatcctcctgttaaatagaactgctttgttttgttattttgtctaagagtgattgaatcaaagaattgagctgatttttgaaaataatgacaagtccgattaaaacaaccaaaatcagtacaatttcaataacagttacgcctgattcatcttccagaaaaagttttagtaaattctgtttcataagtctcacctcctttctaaggaaaatgtgtgtttgactttaatggctaaataaatcaggtaaaatctaaaaatatagataaatcgattaggtaaaacttagaaatgcgggaagcattagaagtgccagaacgattacaagctgtaaaagcatgggaaagagaagttttgtctgtgcttcttctccgagaatccgtgcttttcgtttgcgattttcaagggcgtccgtgacctctttctctaagagcaggagagtattttgatttcctttttttaagttttgaattaaaagtacagataaaattttgtattccggacagggacagcggctgccaaaattttcataagcacgaggctgtgacagcccaccttttaattcatgacaggtctctaaaagtgcttcgtaagcaggacgtttgggcagattttgactccggtaatttttctgataatcgtctgcaattttttcaagacttgcacgtatcgtaagaccggcatgcaaaaacaacagcagtttactgacaagatcgggataatctctttgcatcagtactttttgcttttctattttttcttgttctttttgccgtttcaatggaagaagtaagaaaccgagcaagctaaagaagatacagacaaaaagaccagtctttgcgggttctttataaaagaatagatgctgcccgtcaattgaatcaggaagagcaagggttggattgcttgaagaatcatttgtaactgctttttgaatggaggcatttaatgatttttctttgcttaatttttcaggataaacataaagctctttctgccatgaaagcgtctcttcttcaagcgaaagctgacagcgaagcgtaacggaagcacccttagaagggacatcttctccgatagcaccggtatagtcgagtattttagggtcagaggttgtccaaaaaagctgaacaggacaatcaggaagagattcgggaagagaaagcggtgtatgaatggaagaaaaactcttattttttccaagaatggaagaatccagtttttttgaggcttcatctaaaagagtctgtgattcctctttgctgtaggttttggatggaactttcagtgtaatatggtgtgtttttccatcgtctgtctgaaatttcagggattcttcgtgaatgctttcattgtattcgctacgttttaaatcagtaacaatatcgggatgtcggctctgccataatccaagagaaattcccagaagatttccaaagagaatcagaaaaatactgactcgcagcagggtttgttcctttgcatcttttaggcttggtttcaagtttgctttaggttttaattttgctttagagtttaagtttgttttagagtttagttttgttttagatttcaatttgaaccatcctcctgccaaagaaaaatgctgtcaggtacaagattaggcagattgtcatgatacagactccggctatattgtgatagagaacatcaagaaagcctggagaggtaagacgcatataaagaataattccggcgggcataagactcataaaggtatgttccattttttttgcagaaagcagagagtcaatttcttttttgacgtcaattttttcttcgatgatgcgtgcacttttttccaaagtttcccgaagatttccacccgttcgttttgcctgtgcaataatctcagaaaagttacggatatcttctacctgactttttttaccaagttcataaaataatttttctaccggaacactgagaagcatctgagattccatgtaagataattcaagaaccatttcgctggaagttccgtaaatacgcattaaatctttttttgcttccgaaactgcattttcaagagaatagccggcagaaacagcggcatcaatagaatttaatgcatcccgaaactgatgataaagccgttttcgtttctcataaagaagctgttttttcttaaaaggaagatacagaaaacaaaagggcagaagaagaaaaaaagaaatcacgtttcggtagcataagtcattgacaaggaagcacaaaatcagagagaagaccgaatactgaatccgttctcgaagagaaaaggtataatggtcataagatagtttcacataagagggtttcataagaaattcctgccctttctaatttttcagtgtgtttcagatgatttttaaagacaagcccctgttcttcttcataacagaaaataggatttaactgtacttctccgttttttagtccatccagttcagagatttctaacactttacggcttttgtcacgcagacgtcccagatgaataaaaaggtcaaagcctgagacaatctgacggcggatggcagtaatcggcatattcaagtgaaccagcacaagggtttcaagtctgctgaccatatcggcacagctgtttgcatgaatggtagaaaggctgccttctgaaccaacattgactgcctgaagcagttcgcttgcttcgcttctgacttcaccgacaataatccggtcgggtctcattctaagtgccgtttttaataagtcagcagttgtgatttcctgtgaatcctcgatatttgccattcgacattcaagacggacaaggtttgggattccctggatttgaagctcagcattatcttcaatggtgataatgcgttcatcttttggaatataagcggaaagtgcatttaaaaaagtcgtttttccggctccggttccaccgccgattaaaatggtataacgtgcttttaccagagggagcaaaaaagataatacctgtttggtaatactttgcttttcgagcagagttttcattgtgatggcttctttaggaaattgtcgaatggttaaaatcggaccatccacagaaatcggcggaatgactgcattgacacgggcaccgttttccagtcttgcatccacaatcggatgcagggtattaatgacacggttacagcgggcaacaatctgttgaattacatcttcaagttttccacttgaagtaaaagtcttattccatgtaatcaagtgtccttcccgttcaataaaaattttgtcccatccgtttaccataatttcggtaatgctggtatcttcgagaagttcttgaagcacatcgagttttcggatggagcgaaataactcttttctaagattggctttttcattgaggctcagaccgtagtttgagccctcctgcaaaagcagttcgtcaattttttcgagaatttcttcatcatcggattcccataaagaatttaactgctcaaaaagctgattttgtaaggttaaaaaacaatccataactatgtctcctttgaaaacttaaaaaattaaaaaaagaaaagataagctataaaagataaaaagctgattgaaattaaaagagaaaattaaaggtatccggctttggaaagttcgtattttacggcatcaccaaatacaccggataaaaaagaatctggaaaatgagaactatcaggagggggaagaaaacaagaatgagttttttctaaaatgagttcctgttttgtgttcgttaaataggctttatactgttctgattttgccatagaaacaggttcttttaaattaggcagaaacaaggtattacattcagaaaaaacaggaaagacagcagaaagatttggaccaaaatcgagaaccagagtctgatagggattttcttccatagcaaaaagagcgaagagcgcttcacagtcggcggaagtaagattccagatatcctgcggaacatagacaggagggagataatgaagcgatccatttttttgaatcagtgaagcaagaaacgcaaaaggattttcttttttgtggcgcagcagataaaaaagatcgccgatggtgtaagcggtgttattagaaagaaaataagacagaccggaacaggattcaaagctgataaaaagagttggatttttttcggaaagaaactgggaagctgcaagtgcaaatgcagtttttccacagcgtgcaaccggagaatagataccgatgagcgtcaggttttgagtgtcagaatttgttgaatgttccattgttaagaaaatctgattggaacaaagtttcattaagtcctgaaaaagctgactgcatggttgatacttaaaaagacagggcagatttttcttataagagagattttcttcagaaagtagaatcaaagtttcagaaaatagagaaataagctgtggtgtcagcatggcttctgtggtaagaagcatggaaattgaatggtcagaatgaaacgtaagaagtttttcgagagaagtaaaggggagaaactctaaagaaagagtgcagttttgttgaaagccagaacagagacgacagataaaatcttcgttagaatcgtaaagtgcaatgatttttttggtcataaacaaaatcctccaattaagagcagggtggcaagaaaaatgggaactgtaaaatgaaaatgttcaggacgatttccggatttcatatagggatgaatttgttttttggaaaaaatatcggagacataagaaaagaaataagaaattcgttctaagaaataggcagagcttaaaaacagcaggcaggaaatcaatgcgccgatgaagaatgaaaaagcaatcaaggaaaaaatgtcggaaaaattgagaaaaatgccaagcgtaccaaaaagctttaaatctccagcccccattgcgtgaaaaataaacagtggaaataaaatcaggatgggaagaaaaaaatttttcagggagaaaagcagaccaaaaaagccgttttgaaatatctgataagagaaacccagaagaataccaagaaaaatccagagatttggaactttttgcaagaataaatcacagcagagagctccggcagataaaaaaagcagaaattgagcctgtaaaggcataaatataccagtcctttctgagaaaattggtaaaaataatggaaaaatcatgaaaataaggaataaaaatgacttcgacgaagtgaactaagaatttaagatgtgaatgattatatactttatttcgcccaatgtccagttaaaatgacataaaaaaagatttttgttaagacttcacaaaattactatttgcaataagtgtcattttcagttaaaatagatgttatacaattaggtggacaaaaagtccattgctgaaggagaatagccatgggtgtaattgtatttttaggtgacagtattacagatgcggggagaaccacctcttgtccgccgcttgggaatgggtatgtaaagggatttgcagactccgtcagtcagaattggaatgttttaaatcagggagttgatggttacattacggaacgaattgcagaagacctgcataaggactgtattgcgtttcatccgaattatgtaagtatccttgtaggaattaacgatgtaggactgatagcagaagccgacacaacagagcatgaaaaattgtatatgttggaagatagtattcgtgcttatcacgaaatgttatttgatttatcccgagagacgcaggcagaaatcatcacactggagccgtttattttcccaaaagatggaaaatatgaaaattgggtgccttggcagaaaaagatgtcaaagaatattagaaaactggcgcgtaattaccacgcaagatttatttcggttcaagaacctcttaatcgcgagattgaaagattgggacatgatgccatcaccacagattgtattcatttgaccgcaaaaggtcatgaaattctggcaaagattgtcagagatggatttggactttaaaacaagggagagagtatagttggttaaaatactctctcccttgttttaatacaattcccggaaaaatttctgaaccaaatcaaatcggcttgtcattccggcaagcatggcatctaagataaccagggcagccatacattctactacaacaaccgctcttggaacgataatcgggtcatgacgtcctttgattgagatatccagattttcgccggctcttgtgacactttcctgagtggcagaaatagatggagtcggtttaaatgctgctcggaataaaatttcacatccgtcgctgattccgcctgtgataccaccggaatggttggtctttttcgtaatgtggccagcttcatctgcacagtaagcatcattattatgaagtccgtcggattgtgcaactgcaattccatctccgatttcaaaagcttttacagctccgatagaaagaatggcttttccaaggttggcatttaatttctcaaaggcaggttcgccaattccggcaggcacgccgataatcatacattccaccattccaccggcagaattttgttcttgcatgcaggtttcaagatagtcggaagctttttttgcagcctctgcatcgggcatataaagcggattattttcagcttccgataaatcaaatttttctttattaatagcaacaggtccgatggacaaagtataggcggaaatctgaattccaagagattttaacattttcgccgcaactgcaccggcagcaacacgaccgatggtttcacgtccggaagaacgtccgcccccacggtaatcgcggaatccgtatttgatatcgtaattacggtctgcatgtcccgggcgataataattggcgatttcactataatcatgagaacgctggtcggtattttttaccataagggaaatcggagtaccggtagtctttccttcaaagacaccggaaagaatttccacgcggtctgcctcctttctcatggtggtaaaacgggactgtcctggtttcctgcggtcaagataagtttgaatatcctcttcacaaagcggaagtccggcagggcatccgtctatcacaacaccgatgccttttccatgagattctccccaggttgtaattttaaacaggtttccaaatgttgaaccaaacatagtttacacctctttttctttcgtcttacttgtcgatggattcccagcgtccggaagctccacatggaagcaccagcccgctttcggtaaccggaagaccgatttcctgtgaatctacttttccgttaaattgttttaattcggttgaaatcatataagttaaaacagcaggagcaagtccggttgtataggagttaatcaggaaaaacagaggattgtcacttaaaagtttagcacagagctttactaatgggtgaattgcctcttcaattttccagatttctccttttggtcctcgtccataagatggtggatccatgataatggcgtcgtagtgatttccacgtctgatttcacgttctacaaatttgacacagtcatcaaccagccagcggattggtgcatcgccgagtccggaagaaatggcattttcttttgcccaggtgaccatgccctttgaagcatccacatgggtaacatgagcaccggcagcagcagcggcaagagttgccccgcctgtgtaggcaaagagatttaatactttaatcggacgaccggcatttttgattttttcggaaaaccagtcccagtttgctgcctgctccggaaacagtccggtatgtttaaaactgaatggctttaagttaaaggttaaatttttatactgaatcgtccactgctttggcaggtcaaaaaattcccattctccgccgccttttttactgcggtgataatgcgcattcatttttttccatcctttgtgagtttttggagtatcccagataacctgagggtctggacgaaccagaagataatcgccccatcgttctaatttttctccatttgaagtatcaatgacttcataatctttccattggtctgcaatccacatagtgaaatcctttctatttattagttaactaaaaatataatatgagtgtcaaaaggtatcaattttcttcatattcgttaattagtatagcagaagcgcaaagtcgaggcaatgcgcaaatcaaacagaaatgagttattcttgaaaaaatatctgcatacattgagatagaatatatcattgttaagatacgaacctgcaaaagggaagaaactaccgacaggtcagtatgaaaaatcaggagggcttatgtacgaacaaatggaatgtggcgaagtgtgtaaaagatttcatacagatgagaaagctggactgacgcaacaggaagcagagaaaaggttaaaggcagatgggaaaaaccgattaaaaaaagtcagggaagagacaacgatagaccggattcaaaaacagttaaatgacccgatgatttttgtcctttttatggcagcgtctgtttctattctgcttagagaatttagtgatacggcaattattttattcgtgattggtttaaatacgatgataggtgtagtacaggagggaaaagcgaaaaaggcgatggatgccttaaagaaaatgacagcaccggaagccaccgtaaaaagaaatgggacttaccgaaaaattccggcagaagaacttgtaaaaggcgatgttgtaaaagtgaaagccggagaccaggttccggcagacattcgtttgtttttgtgtaagggaattgaagtaaatgagtcggcattgaccggagaatccacggcagtaaggaaagcctgcgagacgatgaagcaggaggttacagcctctgaacaaaaaaatatgctgtttctatctacggaaattgtgaagggaaatggagaaggaattgtagttgcaacggggatggagacagagcttggaaaaatagccaagatgataaatgaacaggaaaatgaaatgacaccgcttcaaaagagattgggagatctggggaaaatcttgagtaaggcggctgtttttttatgtctgttactttttttgatgggagtgcttcaacatagaaatctgttacagatgctgttgttatccatttctctggcagttgcagcaattccggaaggacttcctgcggttgtaacgattgtactggcacttggtgtggcaagaatggcaaaagccaatacgattatccgtaaattaccagctgtagaaacacttggagcggtcagtgtggtttgttctgataagaccggaacgttgacggaaaataaaatgaaagtgttgaaactttatgcggaggataaaaccttatcggtttctcaggttcgaccaagagaattttcccgtttgatgcagggatttttgctttgtaataatgcagtaatcggaaagacggaactgggggattccacagaacttgcacttctttctatgggagaacagatggggatatcgagagagcggttggaagaacgttatccgagattggaagaaattccgtttgattcagataaaaaatacatggttacgctgcataaagatcagagtcaagtatgcgcttatataaaaggtgcctgtgattatctgttggaagtttgtagtttctggtggataggaggaaagatagaaccgcttggacagattcagaaaatgaaaatcagacgagtaatggaagggatggcagaagagggacttcgggtgctggcactggcttttaaagaacatgtatcagactggaatgaaagcagtattatgaaaaatctggtatttgcaggacttgccggaatgatggatgcgccaagaaaacaagtaaaccagtcagtctatcaattaaaacgtgcaggagttcaagtcgtaatgattaccggtgactatcaggaaacggcattttcaatcgcaaaaatgaccggtattgcaagaaaaagagagcagtgtgtgaccggagaagaattagatgcaatgagtgatgcagaattttcttctaaaatgaatgacatccgtgtgtttgcaagggtaacaccggcacataaagtaaaaattgtaaaagaatttaagaaaaatggaaaaattgtggcaatgacaggagatggagtaaacgatgcaccgtcccttcatgcagcagatatcggaattgcgatgggcgcaaatggaacagatgtggctaaaaatgcggcagatttgattttggcagatgacaatttttccacgattgaaaaagcagtggaagaggggcgcagtatttatgtcaatattaaaaagtcgattttatttttattgtcctcaaactttggagaaattatgacgatgtttgtgtcgattgcattttcgatgccatcgccattaaaagcaagccatattttatgggtgaatctgattacagattcccttccggcactggcgcttggtgtagataaaaatgataccggattgttgatggcaaagaagccaagagatgagaaggaaagcctgtttgcgcatggaggatggctgcttacgattgggtatgggcttttgattggtgcgattactttgtatgcgtttctgacaggcggacagacttatgcatttacggtgcttggaatttcgcagttatttcatgcaatcggaatgagggattgtgagaaatctatttttcagatgaatcatctggaaaatccggttatgattttttctttttttacagggcttgcacttcaagtggcagtgacagagattccgtggctggtggaagcatttcagacccgtcgccttttgatgggagaatggctgtggctgttgggaatttcggcggttccgcttgcggtacatgaaatagtggtgctcataaaacgattaaaaaaagggtgacggtgtaaatatgcaagattttatataaaaaattgcatttaaaacacaaaaattcgtgtataagagataaaaaacgatgaaaatgcaagaaagacttgacaatcagtcataaagtagcatacaatactgcttagtaagccgaagaaaaatgaattggatggcaaattgaaaaaatcaggaggagagccatgacaccgtacagagaactcaacaaagaacagctgcaggtgctgaaagcccagttagaaaaagaatttgaagaagtaaaagcaaaaggtttaaacctcgatatgtccagaggaaaaccgtcaaagaaacagcttgaacttgctatggatatgcttgaagaattaaagagcacagataagctgaaatgtgaagcaggaattgactgtcgtaactatggtttgttagaaggtattccggaagcaagaagacttcttggagcaatgacagaggtaactcctgataaaattattatttttggaaactccagtctgaatgtgatgtttgataccatttcccgttctatgacacatggtgtctgtggaaatactccatggtgtaagttagacaaagtaaaattcttatgtcctgcaccaggatatgaccgtcactttaaaattacagaatactttggaatcgaaatgattactgttccgatgactccaaccggtccggatatggacatagtagaaaaactggtaagttcggatgatgcaatcaaaggaatctggtgtgtaccgaaatattctaacccacagggaattacttattcagaagagactgtaaaacgctttgcaagattaaaacctgcagcaccggacttccgtatcttctgggataacgcatactgcatccatcacttatacgaggagaaagatttcttattagagattttggaagaatgtgaaaaagctggaaatccggatcttgcatataaattcctttccacatcaaaggtaagtttcccaggctccggtattgcagctgtagctgcttctcctagaaacttggaagatatcaaaaaacacatgtcaattcagacaattggtcatgacaaaattaatcagttaagacatgtacgcttcttcaaagatatcgatggtatgcatgaacacatgaagaaacacgcagaaatcttaagaccgaaatttgaagcagtggaaaatacactggaaaaagaaatcggcggacttggaatcggtgaatggaccaatccaaaaggcggatatttcatttcctttgaatcaatggaaggatgtgcaaaggcaatcgttgcaaaagcagcggaagccggagtgaaaatgacagatgccggagcaacttatccttatggaaaagacccgcatgattctaatatccgtattgcaccaagtttcccgaccttagaagaattacagacagcaacagagatttttgtattaagcgtgaaattagtcagtgtagaaaaattactggcagaataagcataaaaaaagccatttgaacattaaaaataaagggcgggattccaaagaaaaggaatctcgcctatttttggataaaaatcacaatttggtcacagaatagggctttacttttgggataaagatgaattagaataaggaatgcataaaagaaaaataaaagaatcaaagaaaaaggggtaggaatatggaacagaatgaaagtggtaacaaaaaaaccgcaaaaccaaagaaaatcataattggtattctgattgcatgcgtggcggtgcttgcgatactctatgcggcaggagcattttatttttccagtcattttctcccgggttcaaagataaatggagtaaattgttctggaaagacacttgagagagtggaaaatcatctgacagatgaaatttcttcttatgcgcttactatcaaggaacgtggagataatacagaaacgatttctgcagataggataggactcagctatgtggatgatggaaaagtggaaaaacttttaaaaggacagaattcatggggttggattactgcatttacaaaaaaacatgaatatacaatgagtgcaaccaccacggttgatgaagaaaaattaacgtcagcaattgatggtttaacttgtcttgcagaagaaaacatgcagcagccggtcgatgcacatttggaaatcggtgataatggatacgaaattgttccggaaacagaaggaaccgctctggataaagacaaggtaacggaggttatcacaaaggcagtcaaagccggagagacagaagtagacctggaagcttctgactgttatttaaaaccatctgtttatcaggatgataaaaatctgattgcgcagagagaccagagcaatgcattcttaaaagtaaaaatcacaattgatttttcagaccgtcaggaagtagtagaccagagtttaattaaagactgggttacaacagatgaaaatggaaatgcagtcttagatgaagcaaaagtaaaagcgtatgtggtagaacttgcaaagaaatatgatacctttggttatccaagacagtttaagacctctaccggtgaaacaattaccgtaagcgggggagattatggctggctgatggcaagaaatgataccacaacaaaattaatcgaggcaattaaaagcggaaagtctcagaccattgaaccggaatatacatataagggatacgtacgtgacacaaatgatatcggaaatacttatgtggaagtcagcctttctgcacagcacatgtggttttataaaaatggtcaattacttgtcgatacagatgtcgtaaccggaaatcataatctggggcatgacaccaaaacaggtatttatgcaattatgtacaaagaaagaaatgcgaccttagtaggggaagattattcctcgccggttaaatactggatgccgttttatgcaaatgttggaatccacgatgcaagctggagaactacatttggtggaagcgagtatttaaataacggttctcatggctgtgtcaatacaccagaagccaatgcagaaaagatttttaataatattgaaaaaggtgtgccggtagtggtgtactaaaacttgagaagctgttgctttagcgatggaaaaatcgtggagtgacagcttctttttgtatatattagtgtatgtatcaggggtgataattcttttggaagtgttttttgtattgcagattgtgtttcaaatgcagtggaacattgacaaagaaagaaaaattgattaggataaagaaaacacaaaaatcaatgtgggcttttataaagttcatgattagaataaaagggagaaaacaaaatgaatatcgtagttttagcaggtggaaacagtacagaaagagatgtttctatttcatcaggagaaggcgtatgcagtgcacttcgtcagaaaaatcataaagctgttttagtagacgtatactttggaaaagaatcttttggggaagaactgtttcctgaagtctatgatgtaaaagcagaagcagacagcatgagagaaatgagtaaattagtggaagaaacaggaaagaccagaaaagaattttttggaccgaatgtactttctatctgtaaagcagcagatatcgtatttcttgccctgcatggagcaaatggagaggacggaaaagtacagtctgtctttgaattaatgggaattccttatactggaaccggcccgctcagcagtggaatggcaatggataaaggaattacaaaaatggtatttgaagcaaaaggtgttccgactccaaagggcgttactttagctaaaggaaagagtgaaacagcactttctgcttatgatatgaactatccggttatcgtaaaaccttgctgtggcggttccagtgtgggagtctgcattgcaaatgatgatgccgaatatgctgacgctttaaaagaagcattttcttatgaagatgaaatcgttgtcgaacagtttgtaaaaggacgtgaattctctgttgcagtagtagagggaaaagcctatccgattatcgagattgcaccgcttcagggcttctatgattataaaaataaatacaatgcaggttcaactatcgaaacttgtccggccaaaattacaccggaacagaccagtcagatgcagacttatgcagaacttggttacaaagtattaaatcttcaggcttatggcagactggattttatcatggatgaaactggcgcaatgtactgccttgaagcaaatacccttccgggaatgacaccaaccagtctgattccacaggaagcaaaagttcttggaattgattacccggaattatgtgaaaaattaattgaagtttctttaaagaaataccagtaggcggagaaaaattatgaaaaatcttacgttagaacatattgcacaggcttgtaatggcagttatcatggcagtgaagcacaggcaaaacaggaagtgcagagtatttttacagacagtagaaaagcggcaaaaggcggtttatttgtgccgattaaaggggcaagagtagatgcgcatgattttattgatcaggtcatggaagcaggagcacttgcaaccctaagtgaaaaagaccttggggagacaaactttccatacattaaagtagaatcctccttacaggcagtaaaagacattgcggaattttatttaaaacagttagagattccggttgtcggaattaccggaagcgttggaaaaacaagtacgaaagaaatgattgcagcagtacttggacagaaatataatgtgttaaagacacagggaaactttaacaatgaactgggacttccacttaccgtatttggacttcgtgcggaacatcagatagcagtccttgagatgggaatcagtgactttggagaaatgcacagactggcaaaaattgcacgtccggatacctgcgtgattacaaatattggtctttgtcatcttgaattcttaaaatcaagagatggaattttaaaagccaaaacagagatttttgatttcttaaaagaagacgggcatgtcatcttaaacggagacgatgacaaattagtgaccgttaccgatgtcaaaggaatcaagccggtattctttggtgtggaaaataaaaacggaatctgggccgatgaaattgagagcagaggcttaaaaggaattgaatgtcggattcatgtaaaagatgaaagttttaaagtgctcgttccgattccgggacgccacatggtttataatgcccttgcaggaacagcagttggtttaacttatggtttaaccttagacgaaatcaaggctggaattgagagcttacagtccttaagcggacgcttccatatcttggaaaatgagaagaaaaatattatggttattgatgactgctacaatgcaaatccggtttctatgaaagcttcccttgaagtgcttcaggatgcactcggacgaaaagttgccctgcttggagatatgggagaacttggaaaaaatgaagtggaaatgcatcgtgaagtcggaagatttgctgccgaaaaagacattgatgtgattgtgtgtacaggaacattatgtaaagaaatggcagaagcggcaaaagaagtttcaaacggaaaaaaagtattatactttgaaaacagagaagcattagaagatgcactggatgaattaattttgccaggtgacagtattttagtaaaagcatctcactttatgcagtttgagaaaattgtaaagaaattagcggaataataaagaagaagtttaagtttattgcttttgcgaatagaaaaatgatggtacatctgataaaatgaaactatagaaaagtacaacgatagtttcgatttgtatgctgattaggtaaggaggtatcatcatgaaaaaaacaatttatgtatgtatttctgctgttttgttaatgtgtttgattgcacttatcacttattatattccggacttaaaaatcaagatgcttgtatcttttcttgttgtgttgacaggaatttatacgattagaatgggtatcattcagaaaaaacgttaattgcatagtaatataaaatgggctgacatatcgagtagtttgatatgccagcccattcttttattcctcatgcgccacaatattttgcaaccagactccttttttcactaagataaatccgatgacacatttaatgatatcacccaactgtaccagcgtatagattccaataaccggaagtgccgtaaaacggcttaacgtaaatgcaatcgttacactcacacaccagataaatacactgtcaaacaagaaggtgataatcgtctttccgcctgaacgaagggtaaaatatgaagcatgcagaaatgcattttgtggcatgaaaattgcggtgatcatgataaagtattttgccagttcccttgcttctgcattggtgttataaagcaatgggaagaatggtgcgagtaccagcatcacaagtgccacgcaggtacagcaaaatacggaaaaggcaatcatcttggtatcggtttctcttgcctttttcatttctcctgctccaagcagctgtccgactacaattgcgacagaatctccaagtgcaataaatacaatattaaagacattgttaatggtattagaaatatttaaaccagctacgacatttaatccacgaaccgaataacattgcgtcagcattgccattcctgctgcccataatgcctcattaaataatagcggtgttccttttatcaagattttctttgtcatataagccggtacttttaaggtacgataaagtccttcgatataagggtttttctctttatggcggtgcgtccagctgataacgatgatggcttctacatatcgagaaagcacagttgcaatcgcagcacctcttactccaagaaccggagctccaaattttccataaattaaaatatagttaaataataaattaattaaaacggctgtaattcccgctttcatcggtacaaccgtctcgccacactcacgaagggtacttgcgtaaacctgtaccatcataaatggcggaagtccgacaagcataatccacaaatactgttttccatacagtaaagttgctgctgcattttcccttgcaccttctccatgcagatacagctcaatcagccggtccccaccaactaaaaaaataacaatggttgctaccgtaagaatcagtgccatccataatttatagcggaaggtatttctgacgccctcctggtctttttgtccaaaatactgggcggtaaaaatacctgctccggatacacctccaaagatgcagagattgtatacaaaaataagctgattgacaatcgctgcgcctgacatctgttctgttccgattcgtccaatcatgatattgtctaacagactgacaaagtttgtgattccattttgaatcataatcggaacagcaatcagcagaatcatcttatagaacttcttatccccgattaactttgaggcaagtccctgtttttttactgctttttctcccataacttctcctttctcctaattcccatccaacatacagtgcgaaagctgtaagggataggatactacacaaacacaattttttcaattgtttttttcgacaatcttttttgccgttttttggcttgctatccaaaagctttttgcttataatatctcttgaatattaataatataccatacggtatagaaaggcggtttttatgatacgttttatttgcgtatgtatcgtagtcatcggttatctgattttatccattccgattctgcttgtagaatgggtcattggaaaattcaacaaacgtgcaaaagacattagttctcttcgcattatccaggcagtctttcgttttatcctgaaaattaccggagcagatattacggtaaaaggacatgaaaatgttccggcagatacagcagtcctttatatcggaaatcacagaagtttctttgatattctgctgacttatgtactctgccccgatgtcaccggttatgttgcaaagaaagaaatggaatccattcctctgttatcaatatggatgcgttatcttcattgtctcttccttgaccgtaaaaatattaaagagggaatgaaaacaattcttttggcaatagaagaaatgaaaactgggatttctatctgcattttcccggaaggaacaagaaatcgaaatgaaagtgaactcgatctgcttccgttccatgaaggaagttttaagattgcaaccaaggctggatgtccaattgtaccgattgccattcacaattcagccggaatttttgaagcgcagtttccgaaaatgcgaccggcaaaagtaatagtagaatatggcgagccgatttatccggataaactggataaagaagagaaaaaacatattggtgcgtatacgcagaatgtgattttggaaatgttaaaagaaatgaatcaatgaaaataataagattatcaaaaaaaactctggctaaaaggtcagggttctttttttttgctctttggcatacattattggtaagtcagcgaaggaagggcaaaatgaggcaaaaaatccatacaggagtgttattgtggtcggttgttatcattttattagcgctatccggctgttcgattgaaaaagtaagcgcacaaaaacaggataaaatcgaatacactattttaaaagaggcggaatttccggaaaaagtgcaggagttgatagaggaaaataaaacaaaagagtttcagcttacttatcaggaacagggaaatttgtatctgataaaggggtatggagagcagaaaacaggcggttacagcatccggattgaggatgtttctctttgggagaatgccatacatgtacagactatgctgattggacccaaagaagaaaatttaaaagacgaaccgtcctatccgtatctggttattcggatggaagacagggatgaaccggttatttttgagtaaagtaaaagcagaaatgataaaaagagatagaaaagagggtataatgtggaactgattacaaaacgagtacatacaatgcggacgaaatgtgaagcagtaagtcaggttacgtttgatgaagatttgaatgtaccggatgtaaaaccggatgtgggacgtatgatacaaaagaaaggagaaatccagatagacgaaatgcaggtatcagacgggcatgtcttttttaacggagcactattggtggctcttttgtatgtcagtgacagtatggaacgaaagatccaaagtctgctcggtacactgccgattgcagaaaccatgcatttagaagatctgcaaagtgggcagaaagtaaaacttgaatgggaacttgaggacttgagtgtccagctgattcattccagaaaattaaatattaaggcattgattacatttactgcaagggtggaagaacttgaagaaattcttctgccggcaggagtggaaacccctgagatttcccagaaaaaagaagaaattccggtaatgggaatctgtatacataaaaaagacaccatgcgggtaaaagaagaaatttcccttgcttcgaataagcctaatattcatgaacttttatgggatactgttgaaataagaggtgtggacattcgtgcaaaaagtgatagaattgcagtaaagggagaactatttttatttgtactttaccggggagaagatgataactactctcttcaatggctcgaacattccattccgttttcggaagaaattgagtgtgcaggctgtgcagaaagcatggtgccggatgttgatgttttgcttgcgcatagtgaattgaaaatccgaacagacagtgatggagaagagcgagtgcttgcagttgaagcgatgctggaacttgaaatccgaatttatgaggaagaagaggtttctcttttactggatgtgtatactccggcaaaggaacttcgggtggtctgtaagccggcaaaattagaatgccttttagtaaaaaatttttcaaaatgcagagtaggagaacgtcttaagacaagtgaaaatcaggggaaaattctgcaaatctgtcacagtgacggaatggtaaaggtggacaatactcatattatggagaatggaatagaaatagagggtattgttacggtcaagattttatatattatcagtgatgacgaaatgccgttttattcgatggatgcaatgattccattttcacatattgtggaggcacagggaataggaaaagaatgtatttatcatctgcatacggatttggaacagctttctacaacgatgattgacagtgacgaaatagaagtaaagattgtattgaatctaaatgcgttggtgatgaaacaaagggaacggccgttgatttatgaaattgaagaacaggaactggacagagaaaaactgcaaagtatgcctgggattgtgggatatcaggtacagcctcaggatacgatgtgggatattgcaaagaagttttatacgacaacagaagagattatccgtctgaatcatctggagtcagaagaacttcatccatttgatacgttgatacttgtaaaatcagttgagagtaaataagaaattttcctattgaaaacgaccaaaagatgggctagaatgaatgtagaatgtttaaaaaagaatacaatgtacaaagaaatatacaggagaagaaaatgagattaagagcgttggcaaaaattaatctgggattggatgtaatcgggaaacgtgaagatggataccatgaagttcgtatgattatgcagacaatcaacatgtatgaccaactggagattgaaaaaaaagacgaaccaggaatttccattacaacgaatcttccatttattccgacagatgaaagaaatttagtttataaagcagcaaaactcttgatggatgaatttgatattcaggagggaatcacagtcgagctgcagaaatttattccggtggcagcaggaatggcaggaggcagttcagatgctgcagcgaccatgattggcatgaatcgtctgtttaatctggggcttactgtaaaagagatgatgaaacgtgctgtggcaattggagcggatgtaccatattgcctgcttcgcggaaccgcacttgcagagggaatcggagagcagttaagacctcttccgccatgtccgaactgctacgtactgattggaaaaccggcgatcagtgtttcaactaagatggtttatgaaaaattagattctgcccaaattgagcatcatccggatatcgatcggatactggaggggcttcagtggcataatttaaataaaatatctgaatatatgggaaatgtgcttgaaaaagttacgattgcacagtatccgataattgaggaaatcaaaaatcatatgaaagaacacggagccgtaaatgcaatgatgagcggaagcggaccgacggtatttggtttatttgatgataaagacacagcagagcatgcatgcgaggcgcttagagaaagcaaaattgcaaagactgtatttttgacaacagtatttaacaacggaggacactgataagatggatttagaaatgcatatggatgaatacctgcctcttagggatgtggtttttaatacattaagaaaagcgattttaaaaggggatttaaaaccgggagaacgactgatggaaattgcacttgcagaaaagttgggggtaagtcgtactccgattcgagaggcaattcgaaaactggagcttgaaggtttggttgtgatggcaccgagaaaaggcgcaaaagttgcttctattacagaacgtgatttaaatgatgtacttgaagtaagaaaaggaatggaagaacttgcaattcgccttgcgtgtgagcggattacaccggaacaattagatgaacttgacaaagtagaaaagaagtttttaaatctgattgacagcgaaaacttaacggaactggctgaagtagacgtagaatttcatgatattatttatgcgacaaccaataataaacgtctgattcaacttttgaataatttaagagagcaaatgtaccgttatcgaattgagtatttaaaagacagtgcggtaagaaggcagcttgcaaaagagcataaatctatttgtgaggcacttcgtacgcatgacaaagaaagcgcactgcgttatgtttatgtgcatattgataatcagcaaaaggcgattatcagaagcctgaatgaagaaaaagaagaataaaaactaaaaaaatggaaatgttaaaagagatgccaaaagaagggcatctctttttattgtgcaaaaaatatattctataaaatatcgggggaatatgatttatgagccattctatcagtatttcaccaaagataaaagaaaatgaatcctgttttcgagaagtattcaaagactgtgcggatattttgttccatacaatggaacttggtcggggaaaaacagtcgactgttttgtgatttatcttgaagtagcggtcagcaatatgattctcgaaaaatccgtacttggaaaattcatcaatgaactgtgcaaggtatctggagatgagattttagagcgggttgaaaaaaatgcattgggaatttcagatgcagtacagctggatacggtagaagatgtggtcgcaggagtatttgccggagatgccgtattttttatagatggatatgcgcatgctgttaagatttcagaaaaaggatatccttcgatgggagtatccgaggcagacagagagaaagtactgcggggttcaaaagagggatttaccgattccgttaaaaccaattcggcactcatcagaaaacgaatccgaaatccgggaatgaaagtcaaagagcagacaattggaagacgcagtcagacaaaaattcagattctttatatcgaaggactggcaaggagtgagattttagaagaactcgagacgaaactttctgattttgaaattgacggtgtgcttgacagtggagtgattgagcaactgacaaaagaaaactggctgtcgccgtttcctcagtttcagacaacggaacgaccggataaatgtgcgatggagctgttaaatggaagggttgtcctgcttgtggataattctccggttggtcttttaattccggcggtgtttaatgattttttgcaggtgagtgaagatgaatatcagacctttgaacttgcaacatttttaagagtgctacggtatctggcagttggttgtgcaatgttgttttcgggactttatctggcggttacggattttcatacacaggtattgccgacgaatctgattttatcttttgcaaaggccagaaggggtgtgccgtttccgggtctgatagagacattatttatggagattgcatttgaaagtgtcagagaagcgggggtgcgtgcgccgggaccgcttggaggtacaataggaatcgtaggagggctgatcatcgggcaggcagcagtttccgcaaatctggtcagtccggtggtggtagtggttgtggcggttacagcactttctgcccttgcaattccaaatgaggaattttctgcaccgtttcgactgttaaaatttggctttatttttcttggcggaacacttggaatgtttggaattcttttgggactctatatgcttttaagccatattgccgagctgaaaagctttggagtgccttatcttgcaccttatgccggaacgcaaagagcgggatacaggggaaaagaaaatggaatctggatgcttccggcaagatttcggacaagacgcccgctgtatgcaaaagaaagtcagaaaattaagcttagaatgaaaacatcggatgaagaggaaagaaaaaatgaaatatacagaaaatgaaacaatatcgcaaaaacagcttttttctcaggcaagtgtttccatgctgggcttaagcctgatggcagttccggaatttatgagattttcgttgaagacgatgatatttggactggttttaacaggattatttttctgggtgcaaagtatttattttgttcgtatctgcccatgctatgccagactttgcacttcgtttggaaattgggtgggaaaactgtttggatttatctatgtatcttacctgtggttcagtcaggtcgtgctgttatgtttgatagcagaccttgccaattattattttatagaacgcatcgacaaaagttggctgattcttttaacaggtatcgtttgtgcaataggaatgtatcaaaatgttgagaaaagaggcagaatcggagaaatcattctgccggtaattttattttttattctttttatgttatttcttgctttccgggatttctcatttgaggaaattatcagggagagccggagaaaaatgacgctaagagagctggcagaggcattttataaaattgtatgtctgtttttgccagtatatttttttccgtttatcttaaatcagacgaagcgaaatacatcggcaaagaaaagcatgaatggaagtgtctgtctgaatcttggaattttacttttggctctgttcctgcttttaggactgcttggaagagaagggtatatgcataaaaaatatccgatgattgatttaatgtcaggagtgaacctgtcaggagatttctttcaacgttcggatctcttttggagtggaagcctgttgttttgtctgttttatttatgtggaagtatcttcttttatcagcatgaacttttaaaacgctgtagattagaacgaggcacatggatagtatatgccagtgtggttttattttctgtgtttgcaggaaaacttgggttttcatttgaaacatatcgtacgctggtccagtatgggtatgggattatgtttccggtcttgatactcgcagcaggaatctggtataaacgaagaaagatgggaaggcgggagcagattcatgaagaaaatacagataaataaaatacgttgtatttttgcagcgtcactcgttgttgttacagcagtttttctaaatggctgtggaatcctgcttgaggatagaacttttgcactttctttatctgtggattacaaagagggtgaatatctggtctggtatggcatttcagatttatacgatgaggtgagtgagaaagaagagagcggtgaggtgaacgaaaaatcggaaaccgaattgaaaggcataagcatggaagaagcaagaaataaatttttgtcaagtcaggaaaatgagctggatatgggacatttaaaagcattgattttgggaaaaggaattttagaagatcaaattgcttatgagggacttttaaatcatcttgaagcacagccggcggtggcatccaatgtatccgtctttttctgcaatgaaatagaagctctaatgaaaacagaaagacagcaggaaattccgcttggggtgtatctgactaaaaagccgaagaaccagtcaaaaaaaacagtcttttcacctgtaaaacttcaggagctttacaggctttggtataatcagaaaaagcagccgagccttccggaaataaaaattttgcaggaaaaaattgttgtacagaataaaccagaaaaataaagtcgatactttgtctgtagagagaatcaaaacaagaaaagtaaaaacagaaaatgaaaaacaaaataaatcaaaaaggcaggcaaggtatgaaaaatgtgagaaaaaagagcgaaaacatcagatggaaattatggatattgtcagccggaattgcacttttgctgatggctggcggtgtccgaatacataagttaaaagaagaaaaatatgaacttcaaaatcggttagaaagagaagtacagcagaacattgcaaaggaagtgcttcggtttcatgtgactgcaaacagtgatacaaaagaggatcagaaattaaaaatgcaggtcaagacagagctgttagaatatatgaatggatttttaaaagaatccgatggattagaggagacaaaagaaatcgtgctgggacatcttacagagattaagcagactgcaaaagaaattgtggaagaaagtggttatgagtatcgagtggaagccaaaatggagaaatgtgagttccctgagaaagtttacggaaactgtacgtttccaaaaggagaatacgagacattgacagttacgattggagctggaaaggggcataactggtggtgtgtactttatccgagtctgtgctttatcaatgattcttatggtgtggtggcagatgaaaaaatagaagaattaaaaaaagttttaacagaagaagagtttatttccatctggaatgatccgaaagaacgaaaaaaagtacggatttcatggaaatggttttaagatgtagcttgcaatccgtaatcaataagggtaaaataagatgaaatacgcagtaaaagagaaaagcgaggcttttttatgaatcagaacagacaagcgccaattggtgtttttgactcaggtgtgggcggactgactgttgcaagggaaattatgcgaaatctgcccagcgaaagaattgtatactttggagatacggcaagggtgccttacggaagtaaatccaaggaaattgtattaaaattttcaagacagattgtaagatttttacagcttcaggatgtaaaggcaatcgtagtggcatgtaatacagcaagtgcactggcattagaagagataaaaaaagaaattgatattccgattatcggagtggtggaacccggagcgaaagttgcagcttcggtgacaaagaacaaaaaaataggtctaatcggaacaaaaggaacggttcattctaaattgtatccggaaattattcacagatatgataaggaaattcaggtgtttggacagccgtgtccgctttttgttccactggtagaagaaggatggctgaaagatgatgtaaccgtagaagtggcacgacgttatgtgactccgcttttggaacaggggattgataccttgattttgggctgcacccattatcctctgcttcgttccctgattcagaaactggtaggagattccgtaacattggtgaatccggcttatgaaacagcaaaagaactcgaacggctcttaaaaagtaaagggcttgaaaatcttcaggatgttcaggaagaatttccataccgcttttatgtcagcgatgccgcagaacagtttcaggactttgcaaattccattcttccgtatgatgtaaagatgacaaagcagattaatattgaggagtactaaaattatgaaaaaagatgtgctggtaacagtaagaggaatgcagtcgattgaatccgtggatggttcggaagaagtagaaatggttgcaaaagggaattactactttagaaatggacatcatttcatctgttatgaagagatgtcagaagggtttgataagccgaccaaaagtatgattaagattgcagataatgtagtggaagtggacaaaaaaggtgttatgaatactcatctggtgtttgaaccggaaaagaaaaatgtgactttttatgcgacaccgtttgggcagatggaaatgggaattgcagcaacaaagattgctgttcaggaagaagaagaaaatttaagtgtctcgattgattatgcgcttgaaattaatcgcatgcataccgcagactgtcagcttcatgttcacgtacagtcaaaagaagcaggagattttcgtctgtgctcataaaaaattttgtcagcaataaaaaagcattgagactttctgacgaaaaagtttcaatgctttttttaaattattttttactgttgtcttttgtcatctgatttgctttcgcacgcatctttttaaagaagccctgttttttaggcggagtttcaagagagcctctcacacctttgacacctgtgatgtagataccactgacatcagcttttacttctttttttaccggaattaaatcaaatacctgttcatcggcaacaagtgtcatgattcttggaccgacttttgcttttacgattggcagcttagaacgtctcataagttttggagtctggtcaattaccatctgaggcagaccggattctttaatcggaagacgcttcttatcaataatcagcatcggtattgtctgttttgctgcttcaatctgttcctgctgtgcttcttgtttcttctgggcttttttgccgagaaaatataaaacggcaagaccaattactataatcagtaatacaatcagtagaacaatccatggactcatttgtaattccctcctaagtatggctttctgacgtatttattattttagcattgtttttgggaaaaggcaataaaaaatatgcaagaaagggtttcttttaaagaaagttatggtataatgggaacgcttggagaatcgcttcaggccaatgcactgcagaaaaatgacgggggatgcagctgcttaacaacacagagaaaggatttataaatcgatgaagaaaaaagtattaattgctcttttggcattgacagttgcagtatctgcaatgggatgcggcagtaaaaaaagcgactccgaagattcaacaaaagccaaaacagaaagcagcagtgaagaggaaaaaacagcagaagaagtggagacagacagcgacggacatgttgtggctgttgataccgatgatatcacaaaatatgtcacacttggagactataaaaatttaagtgtaaaagtaccaaaaacagaagtgacagatgacagcataagcgagtatattaatgagcagcttacttataaaccggaagaaatcacagaagaccgtgcggtacaggaaaatgataccgtaaatattgattataccggatatatggatggaaaagaattttctggaggttcagcgacagatactgaccttttaatcggttccggacagtttattgatggatttgaaagcggactgattggagcaaaaaaaggggatgaagtaacgttaaacttaaaattcccggatccatatcagaataatccggatttttcgggaaaagatgtacaatttaaagtaaaaattaataaaatctctcagccggcagagctgacagacgaatgggtgtctaataacagtgatgtgaaaacggttgatgaatacaaagcagaagtgaaagctaccctcgaaacaagtgcagatatggaatataataataataaaaaatcaaatctgtttgaagcgcttgtcaataaaacagaaatcagcgaatatccggatgatttaatggaagcagcaaaagaaaaagtggaaaaacaatttgaaaattattatgcaaaaccatcaggaatgacactggatgaatattggaagtctcagtctattacagaagaccaggcttcgcaatatattgaggctcaagcacagaccaatctgaaacaaaatatgattgtacaggctgtgcttgacgcagagggaattacctttacaaaagatgaatacagagaacagctggataaatttgcaaaagaatacggatttaaagatgcagaggcattagagcaggcatacacagatgctgagcttgtaaaagacaatgttttatggagcaaagtatgtgacattcttgaaaagtatggaacaattacagatgtagctgaagacgagacaaccgatgagacaacaacagattccaatacagcagagtcatccgattctacagagacaacagcagacggggaaacacagacagcgaattaagtggtaactctttccctcttttgcatatactaaaatgagtataggcaaaagggggatttttgttgcaaagaaaaagcgtaagggatgatttttatgaacaggagcggtatgcaaatcaggagttacgtcgtttccgtgcaaattatccagagaatgcggcattaatccagaactatgtggaggatgcctgtgaccggatggattatgagggcagtagaatgtacgatgaatatccggacaggtatatgctgaagaaaaactgtgcgtcgatttcaaaccggataaaaaaggacagcgagacgatgggagtggaagcaggatttgcgaaaaagtgtcagaatcttccaaaggaaactttagatgacttagttgaagtcttgttctataatgaggtgtatcgcagacggttgaggcgtcgcagaggaaaaagattttatccgtaacagacagggaaaatatttttgggacttgcgattttagagtaaagcttttacaatagagacaaatgccgtaatggtattttgtacagcgagtattaaaaagatacttgatttacgctgtatcaggcagactgcaatggatgcagtaaacaagtgtttagttaggagaaaacatgacggaactagcgggatttttagaaacttatgtaaatacgcagatgatacggattataataagcggccccagaaaaaaggaggggccgtctaaaatacagattcgtccgctgtcattaaagggagaaatcaaatttcaggaaactcagacagttggacaaaaagaacttcataaaaattatgagcaaaatgaaattatacagcggatgttagaatggatggaacattcttttaagcagttgcagttagagggacaagatatcgatgcgacggtactgataagtaagaagggaaaggcaaccattaaaataaaaaaaagccggacccccaaagagtttgtgccaatgctcgcccataatcgaaagaagaaatatctgctggaagaaggtcggccggttccttttttaattgaccttggcgtgatgagtgaagatggaaagataaaaaacgcaaggtatgataaattccggcagctcaatcgtttccttgaatttattgaggatatcttaccgaagcttccaaaagaaagggaagtgacgattcttgactttggatgtggaaaatcctatctgacttttgcaatgtaccattatcttcatgaattaaaacattatgatgtgcatattatcggactggatttaaagacggatgttattgaaaaatgcaatcgtcttgcagataagtatggctatgaaaaattgaatttttatcagggcgatattgcatcttatgaaggatgtgaacaggttgatatggtggtcaccctgcatgcatgcgatacggcaacggattatgcgttagaaaaagcggtaaggtggaatgcatcggtgatcctttctgtgccatgttgtcagcatgagttgaaccggcagataaagaatgaaatgctcgctccgattttagaatatggaattttaaaagagcggttttctgcgattttgacagatggactgcgtgcccagatgcttgaaagtaaaggatatgacacacagattcttgagtttattgatatggaacataccccgaaaaatctgttaattcgggcagtgaaaaatgagaacaagaagtacagtgaacagcagaaagcagcatgggaagcctgcatagaggcatttcatgtaaaaccaacgcttcaaaaagagctgttcttagaagggaatcataaataaatgaaaaaaatactgacgaaagcagggattcttctgttggtctttatacttggagtgataggcttcagcagtctgatgaataaagagaccacagataataagatggatcttgaagaagccacgttgcctgtgatgagcatgaaaataggaggtgaaaaagcgaaccttatgtatggacatgctgggcagatgcaggtggattttatgagggaaagtctgacaccgttagagacagacaaggaactcacagtcagcattacaccaaacggtcataaaataaaagatttggtttatgaagtccgtacatcagatggaagcaaagtcattgaaaatgataagataaaaaatttcaaaaaagatggcgaggataaaaaggttacattttcacttcagaaatcaatcttaatgaatcaggagtactcgcttgcgtttacactgacaacagatgagggagactactactactataccagaattttacagcgttccggattgaatacagagaaatatctgcaatttgcaaagcagttttctgaagatacgtttgattcagatgcacgttcagagattgtctcttatctggaatcagatgattcaacaagaaataacagctttctggatgtcaatattcattcgagtgtcagtatggttatgtggggagatttgaatccgtcggttctttctgaaggaattccggtcataaaagatatcaatggaacgactggaagtgtaactcttacttattacattacggcagacgacgatgataagaatcaggagctttatcaggtagaagaattttatcggatgcgctatgatggaagtaagatgtatcttttgaactttaaccggagtacaaaacaaatctttacaggtgattcaagcagtattgcaaacggaagagtgaatcttggtgtgacttccaaaaatgttcagtatgtggcaaataagacaggagaaatttttgcgtttgtacagcagggagatatctggtcttataacactgcgaccaataaattagtgcaggtgtttagtttccgtaaacaggatgcaattcaaaattttgatgcaagagaaaatatttctcagcatgattttaaaatcattcgtgtggaagaaagcggagatattgactttgtggtatacggatatatgaaccgtggagaacgggaaggtcagacaggaactgcagtttatcactattacagcgaccagaatgtattggaagaaaaagtatttattccaagtctgagttcctatgagtttatgaaacaggatgtgcaggtgctttcttatgtttctacagacaatatgctgtatttgtatcagcaaaaaaaattgtatcgcattaatctttcagaaaaaacttatgaagtggtaaaagatggaatcgacacacaatgtttctttacgtccaattccaaccgtcatattgcatggttagaagagatgaagttatttgattcttctaatattattgagttggatttggaaaccggtgaacagaagaaaattacggcttcggatggaacgagaattcgtgcgtttggatttatcaatgaagatttggtttatggcgtagcagatgaatcggatattaagacggattctacgggaagtttttattatgcgatgaatgagcttcggattcaaaactttgatggcgaactggtaaagagttatgctgaggatggtgtttatattacagatgtgaaaatttcgcagggcttgattgagctgtcaagagcgcagtggcagaacgaccattatgctgaaattacaagtgaccacattatgaacaatgtaaagacaaaagaagaagaggttgcgtcaatagcaacggttacgacaactcgtcaggcgggaattaccagattggtgtactcggacgaaaataaaaataaaaatccgcttgtctcagttccaaagtggatggtattggaagacagcacgacgctggaacttgatgagggaacggatgataccaattattattatgtgtatgcaaatggcgggctgtacggaatttatacggatgttgcaagtgccgtgcaggaagcagatgcacagacaggtgttgtgttaaatcgtgcacagcagtatgtctgggagcgtggaaatacaaagactaaagtgacattaaatgtcgctgagattccagactggtttaagagtgcaaagaccgatgtttcttatctggaagaacagttgggagatggcggaacagtgatgaatctgacaggatgtaccctggaagaagtgttatatcaggtcagtgcacagcgtccggtgattgtaagccttggagatgcaggaaatcgtgtgattgtaggatatgatgcatacaatactctactttataatccggcagaccagacaacatcttatatgggaattaatgacagtactgcagcatttgaggcagcaggcaacgtatttatcagttacattgaaaagaagattgaataaaaaaatgagaaaaattggggcaaaatattttgctccaatttttttgcaacaaaatggcattaaaaagacactataacaatatagaaagaaaagtacgtttggaaaagtaactgtaaaattgtaaaatcaaggataaagcacagaaaaattccgaaagtacattaaagagggaggagggaaaaaatggaggaaagtcgggagctggtaagacaggcaaaaaagggaaagagagaggcatttgcaaagctttatgaaacagtatacgaggatatgtaccgatttgcactttacgtgttaaaagacagggaagatgcagaggatgctgtggcagagactgtggcagatgcgtttgaatccattggaaaattgagaaaagaagaagcatttcgggcatggatttttcagattttatccaataaatgtaaacgaaagctaaaagaatatataacaaaaacctattcttatgaggaaagtgaacaaaggttagaaaaagacagcaaaacagaggatatagcacacgctattcacgtaagagatgcattttattctctggaagaagaggaacgttacatggtggcacttcaggtgtttggaggttataaaagtcgggagattgcagcacttttacataaaaatcataatacagtgcgttcacaagtaagccgggcattaaagaagatgaaagaaaaactggattaggaggtgcagtgatggcgaaaaaagaagaatatcataatttaaaagacctgcagtcagatgagctgaacctggaaaaagtaatagaaaagattcgggaagaagcaaaagaagaagaaattccagaacgcttgaaaccggaacatttagatgaaattttaaattcacagaaaaagaaaggcaggtggcaggggatgaaaaaaagaaaatatatggtagcagctgcatgggtggcagttttagtcggaattggagtttccagcgtagcacttattcataaaaaggattcggcagaaattggtgcacagacagcttcttcggcaaaagacggaagcggaaacagtaccatttcgcaggaagcttcagcagaagaaaagcaggtggaaggttataaatctgcttccagctatgaagaaatttatcagaaattatttgtagagacaaagcaggcacaggaaacacaggaggcatggtattcgagttcatcgaatattgatgaagattatggaattatgaaggaaagtgctgtggccgatggtacaacctcttcaatggcaaaagcggtttcagaagataatagttcagacagttattcccggacaaatgtgcggacagagggtgtagatgaaggggatttggtaaaaacagatggtacttatatttatacgttaactcgttcaggcagactgatgattacaaaggcagaaggaagcaaattagaaaaggcaggagaaacttctcttgaaagtatgacagacaccatcagtgacatgtatgtggatgggaatacggtttgcgtcgtagcctacggatatgacaccgatgtctcgatggaaggagaagatacttatgcggtcaattcgacaaattatacgaaactttacacttatgatgtatcagataaatcaaacatcgtattaaaaggaacaatcaagcaggaaggatattatgagacatcaagaaaagtaggaaattacatgtatctgttttctacctattatgcccaggaagaaaatgcgtctaaagaccatccggaacttttagtgccgaagattaatggagtgccaatacaggcttcggatgtattttgtccggtagagcctcagacagatacgactcagcttgtaatttcttctgtcaacttagaggaaccggataaagtgatggcaagtcgttctttaattggagctggtggaatgtattatgtcagccagaataatatctatgtttgcatgagtcaatatcagacacaggagataacaacacagattgcacgcttttcttatgcagatggagcgttggaattaaaagcagccggacagattaacggaacaattcatgacagtttttgtttggatgaaaataatggctatctcagggcagttgtgactcgctatccgaatggatggggtggacaggaaagtaatggattatatgtcctggatgaaaatatgaaagtcagtggaaaaatcgaagatcttgcatttggagaaagtattcagtctgcacgatttttaggagacaccggatattttgtgacttataaacaggtagatccgctgttttctgtggatttaaaagaccctgaaaatccaaaagtgattggagagttaaaggtgaccggattttccgagtatctgcatttttatggggaaaataaactgcttggaatcggacaggaaacggatccggacactggagaattaagaggaattaaattatccatgtttgatatttccaatcctgccgacgtaaaagaagtcgataaaattgtattaaaagatattgatgtttacagcccacaagataattataagagtgtgatgattgatgcagatgaaaatatcatcggatttgcaatgggctcttatgataaagtgacttataatctgaaggggtattatggagtttttggttattcagcagaagatggttttacgcaggaactgatgcagagtttaagtaaggcaaccggaaattcatccgacagctacaatgtaattgatgaaacaagaggaatttatattggcgataccttttatctgtgccagaatcagggaatctatgcatttgaccggagtgacggatacaaagaaatcggcaaacttgagtggtaaaattcccttgcgaagcctattacaatgcgttatacttatgtggagcgggtttcctgctccacttttttcattacattttgagaagtaataaaaaactggatacacagggatggaaataaaggagaacaaatttatgaaactgacaacagtaaaagagatttacaaaaacagagagcagtatcttgataaagaagttactgtaggcggatgggtgcgaagcgtacgtgattccaagacatttggctttattgtgcttcatgacggtagtttttttgaaacccttcaggtcgtttatcatgattccatggacaatttccaggatatcagtaaattaaatgtaggagcagccattattgtaaaaggtaatttagtagcaactccacaggcaaaacagccgtttgaaattcaggcagaagaaattatggtagaaggagaatcagcaggagattacccactgcagaaaaaacgtcattctctggaatacttaagaaccatttctcatctgcgtccaagaacgaatacgttccaggcagtatttcgtgtacgctccctgattgcttatgcaattcatcagtttttccaggagagaggattcgtctatgtacacactccattaatcacaggaagtgactgtgagggtgcgggagaaatgttccgtgttacaacattggatatggaaaatcttccaaaaacagaagatggaaagattgattacagcaaggacttcttcaaaaaagaaacaaaccttactgtaagtggtcagttaaatggagagacttatgcgcaggcatttagaaatatctacacatttggaccgactttccgtgcagaaaactccaacacaacccgtcatgcggcagagttctggatgattgagccggaaatggcatttgctgatttggatgataacatggcacttgcggagtctatgttaaaatatgtaatcggatacgtgttggaacatgcaccagaagaaatgaatttctttaattcttttattgataaaggtttattagaccgtctgaatcacgttatgacttcagaatttgcacatgtgacttacacagaagcaattgaaattctggaaaaagtaaacgacaagtttgaatacaaagtattctggggatgtgacctgcagaccgaacatgaacgttatctgaccgaacaggtctacaaacgtccggtattcgttacagattatccgaaggaaatcaaagcattctacatgaaacagaatgaagatggaaagacagtagcagctatggactgccttgtacctggaatcggtgaaatcatcggaggaagccagagagaggattcttatgaaaaattaaaagcaagaatggatgaactcggcttaaatgaagaagattacggattctaccttgacctgcgtaaatacggttctacccgtcattctggatttggtcttggatttgaacgctgcgttatgtacttaaccggtatgcagaatatccgtgacgtcattccgttcccaagaacagtaaataactgtgatttataaaatggtttgaatatgccattttatgggagtttgacatcataaaatcagatgaataaaaaaatcccggagcactaatatcagagtgctctgggatttttttgattattttttatttgccagatttgcgttatgttttgcaaggaagcggttgatccgttcaactggatttaacaatttgctgatagaagaatcatgatttaaggtatcaatgagtaaagcaatatatttactcatatcacagtttacatagtattctttctgaagcagttcttctgtctgataaaccagatttgtggtaagcagacggtcaaatgcacctttttcataagcttcatcaaattttttgagaccattggtgaacagtccaaaagtagcgcacataaagatttttgcagctcctttttcttttaataaagcagcaacttcaagcatactgtcaccggaagaaatcatatcgtcgatgataatcatatttttgccttttacgtcagcaccaaggaattcatgtgctacgataggattacgtccgtcaacaatagtggaataatcacgtcgtttgtagaacatacccatatcaacaccgagtacgttggcgagataaatagcacgtccggtaccaccggcatccgggctgattaccatcagtttgtcattgttgatttcaatgtccggttctgcacggaacagaccttttacaaactgataagctggctgaactgtttcaaacccatgaagcggaatagaattctgaacacgagggtcatgagcgtcaaaagtaatgatgttgtcaactcccatgtttactaattcctgaagtgcaagtgcacagtcaagagattcacgtccggtacgtttatgctggcgactctcataaaggaacggcataataacattgacacggcgagcttttcctgcgatggctgcaatcacacgttttaaatcctgaaaatggtcatccggagacatgtgattggtctgtccgcaaagtgagtaagtcagactgtagttgcaaacatctaccatgagatagatatcatcaccacgaacagattcttttaaaattccttttgcttctcctgagccaaaacgtggggtttctgcctgaattaaataagagtcgcgttcatagccttcaaactccaggttgttaaagtgagaatattctctgtctttacgccagtctacaatgtagtcgttgacccttgcgccaagagcagaacagctctttaacggaatgattccgaggcgtcctacaggaagtgaatctaaaggtgtggtatcttttggtgatggtgacattttttactttcctcctaatagttttttttggattcttatgtcatttccaattagtttgagcatggtgtaattactggatattctggagaagatacgttctgagtaagtttccagaaaattttccatggtcaggtttgttgatataatagtggatttatgattgataatgcgctcatttacacagaaaaacagctgactggcaacgaaagaatttacaagttccgtgccaaggtcgtcgatgattaataaatcacagtttgctatatattctgccatatctgaggcagcagtatcctttttaaatgtgttttttgccaacaggtcaaataaatcaaaagatgaaaaatataagacaaaataagacctttggattaattctttggcaatacagtgggaaagataggtttttcctacaccggtatcaccgtaaaagaaaatgccggcaggatggctggcaaaattatcaataaaatcccagcatttaaagtaagcatcccttgcggtttcaagtgcatttaagccggtagcgggattttttacttcctcagaataatattgaaacgtaaagttttcaaaattttctacttctaagatttcgcggatatttgactgtgtataaagtaagtcaacagccgccttgcgaaaacaggaacatttctgattatcgacatatccggtatccttacagtgcggacagtcatagtgaagttccagataatcagcgggaaagccgtttctaagaagcagtgtcctgcgttctttggagagtgtttcaatttcatcagagagattgaaatctgctgatgaagaaggcataagaagagccctggctttttttaaactaagggatgcaatttcgttgtcaatctcctgaagcctgggaatccttttataagcaatccggatacggtctcgctgttcatgtttatgttttaattgtttctggttatattggcgcataagtgcgtcgtattgtgagttatttagtgacacagtttttcctctttttatttgttcaacagcagtttttcaagttcattaacattatacgcacgctgatgaaagttattgaatttattgcgggaggcagatgactgagcacggggagccggagcctcgttttttgcagcctttgcctgtttatgagaatcttccagcttttccacatcggcaacatcatgaacagctcttttctgccagcttcttaaaattgagtcggcataaggaaaatttggctgaccggttgccatgactgccttgctgcaggcaagggaaataatttcaagagaaaatccaagttcgtcaagccatacattcatgtagcggatttcttcatcaatcggatttcggtttttaatcccaaacgcgcgcaaaatcgcaaagtaatttttgttgtatgcagtggttgccgcctttgcctgttcaatagttgtgatattctggtcagcccaggaaagtgctacggtttctatgtagcggatgctgtggctgccttttgatacacaatactcaatcaggtattccataaggtcggttgaaaaatgaagttcgtcataaaaatacaataatttattaatttcgattggagagagtgcttttccaagatactgttctgcaacaaaaagtatctgaataacatcttctcgttcggttaaagccctgattttttccgccgataaagaagacggctttgcaagttcatttgaaacagcttccgaaccggttggaatttcagtagaagttgaggctgtagaaactatatttgcagcactggttggagcctgcggaagatttgcgcccacaggaagcagacggacactgtttaaattgccttgttcgtccaattttaaatcaagcactcctgatttatgccagtattttaatgccctgagcacatcattttccgtacaattaaaaatgtcggcaatcgatgacagctcaagtgaagcggaaacgccggtggcatttcgtaagagataaagataaaccttaacgaattccccgtttgcctgtggcatacagacatcgaggaaatagttggagattaaagtgtaatctccgggaaaatcattacagagtgtaaactgtcccatttccaacatccttttctaatcaatctatgtccaaactcagtataacatagaatttttgaaaagagaataagcattttttgacaaaaaactctgcagacatttccttaaattagatattaggaatgcctgcagagtatataagttcttacagcccgagcagatgttctccgattttataaacatcgccggcgcccattgtaattaataagtcctgcggtacacagttttccagaaggaaatcttcgatttcgtcaaaagtagagaaataatgagcatctgttccaagtaaggaaattttttcctgaaggtctttggaagaaattcccagtgtatctgtttctcgtgccgcatagatatctgcaagcacaactttatctgcaaggcttaatgcctgggcaaactcatccatcagtgcttttgttctggtataggtatgaggctggaatacacaccagattgttttatgtggatagttttttgcagtgcgcagtgttgcggcaatctctgtcggatgatgtgcatagtcatcaataacggtaacacctcccacttttcctttatactggaaacggcggtctgttcctccaaaatgcaggagacctttctggatagattccagggaaagaccaagttttcttcccagtgcaatggcagacaatgcatttgagacattgtgaatgccaggaacggaaagtgaaaaatgaccaagtaaagtacctttttccatacaatcgaaggaagcgtgtgcagtttcatcaaattcaatatttgcagcagtgtaatctgcatcctgttccagggcataggaaataatttcgcatggtaaatcctttgtgatttcggcaacatttggaatatcctgattgataattaaagttccgtctttcggaagtttttcggcaaacaatcggaaagaatgacgaatatcatcaatatctttaaagaaatccagatggtcggcatcgatatttaagataatgctgattttcgggaaaaagcttaaaaagctgttcgtgtattcacaggcttctgtaacaaaggtttcagattcgccaacacggatatttccatggattgcaggtaagattcctccaacggaaatagtagggtcagcgtctgcttctaagagaatatgggaaatcatggaagttgtagttgtctttccgtgtgttccggaaacagcaattggagtttcatagttgcgcataatctgaccaagcagttctgctcttgtgagcattggaatctgtttttcttttgcacaggcaaattccggattatccggatgaatcgcagctgtgtagataacgagttcaatatcgtctgtgatattagaagcacgctgtccgatatagacttttgctcccagactttccaagtgcgttacaaggtcagaaggtttggcgtccgaaccggaaattttaaaatcttcttttaaaagaatttcggcaagaccactcatgctgattccgccgataccgataaaatgaatgtgtaatggtttattaaaatctatttcatacataaggcaacaagttcctttctatctttaattccttaacttttacatctttcaatagttcattatacataaaaaaaatgggaatgaaaaccctttcttaatcaaaacgttagagacaagtaaaatgtcacaaaaacaatggaaaagtcgaaaaaaaattgttaaaaatgttcacaattttgatttgatgtggtataatagaagaatcataaatatatacaagaggtgattacatgattaagaaagagatgattgccatgttgcttgcaggtggacagggcagccgtttgggtgtactgactgcaaaggtagcaaaaccggcagtttcgtttggaggaaaatatagaattatagatttcccgcttagtaactgtattaattcaggagtagatacagtcggagtactgacacagtatcagccacttcgcttaaatacacatatcgggattggtattccgtgggatttggataaaaatgtaggtggtgtttccattcttccgccttatgagaaaaaaacggatacagaatggtatacaggaacagcaaacgcaatttaccagaatatggcatatatggaaacctacaatccggattatgtattaatccttggtggtgaccatatttataaaatggattacgaagtaatgctcgatttccataaagcaaataaagctgacgtaacattagcttgcatgccggttccgtgggaagaagcaagccgttttggtctggcaattacagacgagacaggacgcatcacagaatttgaagaaaaaccggaaaatccaaagagcaatcttgcatctatgggtatttacatattcagctggccagtattaaaagaagccttacttgcattaaaagaccagccaggctgtgattttggtaaacatattctgccatactgcagagaaaaaggtcagcgtctgtttgcttatgaatataatggctactggaaagatgtaggtacacttggctcttactgggaagcaaatatggaactgattgatatcattcctgaatttaatttatacgaagaattttggaaaatctatacaaaaacagatattattccgcctcagtacatttcagcagaagctgttgtagaaagaagtatcatcggcgaaggcagtgaaattcacggtgaagtttataactctgttatcggacctggtgtagtgattaaaaaaggcagtgtagtgcgtaactctatcattatgaaacagtcctttatcggagagaatgtaacaattgataaggcaatcatcgcagaaaatgttacagttggaaataacgtagtaatgggtgttggagaagacgttccaaataaagaaaaaccaagtgtatactcttttggtttagtaacaattggagaaaattctgttattccggcagacgtaaaaatcggaattaacacagcaattgttggagagacaacaccggaagattatccggatggagaacttgcaagtggagaaactttaaataaggaaggtgagacagcatgagagcaataggaattattcttgccggcggcaataacaataaaatgaaagaattatcaaacaaacgagcaatagcagcaatgcctgttgccggaagtttccgcagtatcgactttgcgcttagtaatatgtcgaactcccgtattcagaaagtagcagttttaacacagtataatgcacgttctttaaatgaacatttaagttcttcgaaatggtgggactttggtagaaagcaggggggcttatatacattcccgccaaccattactgcagataataacttctggtacagaggaaccgccgatgcaatggctcagaacttaaatttcttaaaaaacagccatgagccttatgttgtaatcgcttccggtgattgtgtttataaaatggatttcaataaagttctggaattccatattgcaaaacgagcagatgttaccgttgtatgtacggatgttccggctgatgaagcaaccagatttggctgtatcaaaatgaatgaagactgcagaattcaggaatttgaagaaaaaccgatggtaacacataccaacacggtttctaccggtatctatgttatcagaagacgtcagttaatcgagctgcttgaaaaatgccaggaagaagacagatatgatttcgtaaaagatattctgattcgttataaagaattaaagagaatctatggatataaaattaatacatactggagcaatatctccactgtagatgcttattatagaacaaatatggattttctgaagccggaagtcagagattacttctttaatcagtatccatccattcagtctaagattgatgatttaccaccggcaaaatacaatccaggttcacaggtgaaaaacagcctgatttccagtggatgtatcattaacggacaggtagaaaattctatcttatttaaaaaagtatttgtgggtaataactgtgtaatcaagaactctatcattttgaatgatgtttatttaggtgataacacacacattgaaaactgtattgtggaaagtcgtgataccattcgtgcaaattcttactattgcggagaagaaggcatcaagattgtaattgagaaaaacgaaagatatgtattgtaatgactaagcaggtttttacaaaataaaagatacaaaaatcggacttataaagagggctttttgagaaggctatgaaaggggaagggtttattatgaacatcacagatgtaagagtaagaagagttgcaaaagaaggtaaaatgaaggcagttgtatccatcacaattgatgaagaatttgtagtacatgacatcaaggtgattgagggtgaaaaaggattgtttatcgcaatgccgagcagaaaagcgactgatggcgaatatagagatatcgctcatccgattaactctgaaacacgtgaaaaaatccagggaattattcttcagaaatatgagcaggtacttgcagaagaaccggtggaagcagaacagcctgcagaataaaaagaataagagcgaaaatgaaattaaacggtatgtctgtagttgcaggcataccgtttttgctatataatgcttcaaagaataaatactgtaaaggaaataaaactatgattgaacaattgccaaaggcatttttagagcgtatgaaagccatgcttggagaagaatacgaagattttttaaaaagttatgaagctccccgccagtttggtctgcgaatcaatacgctgaaaatatctgtagaagaatttttaaaacagtctccatttcatctaactaaagttccgtggacagagaatggattttattatgaagaagctgaccgtcctgccagacacccttactatgcctccggactttattatcttcaagagccgagtgcaatggcgcctgctgctattttaccggttgctccgggggactatgtattggatttatgtgctgcaccgggcgggaaggcaacggaacttggcgcacgcttaaaagggcagggcatgctggttgcaaatgaaatcagtgcctcaagagcaaaagccctgcttagaaatattgagctttgtggaattaaaaattcatttatcacaaatgaagttcccaaaaatcttgcccgtgtgatgccggaattttttgataaagttttagtcgatgcaccatgttcaggtgagggaatgttccgaaaagatatggacgttgcaaaaacatgggatgagagtcgtccggaattttttgcaaatctgcaaagagaaatcgtttcaaatgcgatttccatgctaaaaccaggtggactcatgctgtattccacctgcacctttgcgccaatcgaaaatgaaggaacaatttcgtatatccttgaaaatttcccggagatggaacttttggaaattccggcttatgaaggattttcagagggaaatccagaatggggaaatggagacgacaccttaaaaagatgtgtgcgtattttcccgcataagatggcaggagaagggcattttattgcactgttgaagaaaaaaggaattctgtatccatccaagtccgatgtggcagtccagaaaccggaaaaagaagcatggaaattattaaatgaattctgggcgccaatggaacttccatttgaaaaagaacggattgaaatccgcaatcaaaatgtatattatctgccgccggcatcgaatcactataaaggaatccattttgtccgaaatggtttattcttaggagaattaaagaaaaaccgctttgagccatccgaaccactggcgcttgcgctctcacaagaccagtttcctgcaattctgaacctttcgagtgaagaggaacgggttgcacgttatttaagaggagagacacttttaatcgaagatggcgaagcaaaagtgaaaaagggctggcagttagtatgtgtggatggacatccgcttgggtttggaaaactggtgaatcagactttgaaaaataaatatccggcagggtggagaagaaattcgtaaagaaattgaaaaaggattggaaattgaatgcttatctgcgttcaatttccaatccttaaaaaataaaagaaaaacggtacgacatttctgccctaccgtttcttcgttgaagtcgaagcgacgtgattcgaacacgcgacctctgcgtcccgaacgcagcgctctaccaaactgagccacgcttcgttaaaatgtttttcgcattcaacatttgcaattatactggaattgaatcaaattgtcaataaaaaaatgaaaatttttaatttttttttcatatacttttgacatttgcatcatatacttttaaagaacaaattttttggagaattacatgtctggatatcgacgatttattgcttatgtatatgaatatgagggaagaaaaaaaggaaatggaaaaggatttataaaagttgaagttcgggatggagtctgccggatgcagtttcggctgtcaggtgtttatggacaggaaactcttccatgtgaaatttatggatatgtaagagaggaagaaaaacaggaatgtgaagcagtttatcttggaacttgtgatttggcaggagaaattattgccttttcactggaactaacaggagaaaatgtctcggaaagtggatattcaatcgatgatttcaatggaatcgtgtttttagccggtgatgtgatgtatggaaccggctgggatgaaaatccggtgtgtctcgatgaaattcggtttggaaagaaaaaagaagaaaatggagaagagatagaagaattaaaagaagaacctgaagaaacagaaggtgaagaggaaggcagagaagaaacagaactggaaatacaggaaaatccatttccaccgacaccaagtatcttagaagaagtcggagaggaatgtcaggaagaaataagtgaaacaggagaaatagaagaaaaattagaggaaccagaagagccggaggaatcaggagcgttagaagaaccggaagaatcaagtgaactcgaagaatccttctactgtccatttaaggacggcgaatttgaacagtgtgcaaaaattggtcttttggattataatcagctaaatccatgtgaccagggacttttaaataataatttcctgcgttatggatggagacggtataaacatgccttgattggaaaagatacgaagagaaattgttacatacttggagtgccgggaacgtataacagacaggaagcactgatggcgggaatgtttggattcccttattttaaagaagcaaaatgcgaaacaaccgaaatgtctgcacaggaagtacaaggacatttcggttattggtatcggtcaatcaatccccctgatggaaacagagggaatcgttcttaataaaatcttttgaaattgttctaattcggtttttgtataactggtgaatccgggatgaatcacatccggagaatcgcggtatgcctgtaagaaataggcctgacatccggcaatccacttaccgatagattcaaaatcggctttgtcatgaagttcacgtacaacggtagtacgaaattcgtaaggaatcacattagagagcagaaattcaacagattcacagatggatgttaaatcaatgtttttgcagccagatacttttgcataagattctttggaagatttaatatccattgcaaccatgtcaatcatctgattgttcactaatttttttagagtccatggatggctgccgttggtatcaagtttaactggataaccaagttctttgattttatcaatcaacagaaacaagtctttatccaaagtcggctcaccgcctgtgatgcagaccccctctaaaattccctgacgtttttttaaaacagaaaggacttcttctgtgaaaatcacaggctgtttatttggagagagtacgagagaactgttctggcaaaatggacagcggaaattgcacccgccaaggaagatggtggatgcaatttttccggggtaatctaaaagtgtggttttgttaaatccgttgattggcatggtggaaatcctttcttgctttagggatgataattcgggctaatttccgtgtccctcttttgaaaaacgttcattatattcactcagaggaatgaacgtgtcactctgttttgcctgatttgcatgataaaagagaaaacctgcaccaatcaggataagtaaaataattgcaaaaattatgtttctggtttttgtcatgggcattctcctctctaaaatttgaacgcagataagcattcccccgcttcaagtgcgtagagcactaagcggcgagtgagcactttacatcacgttttttatatctaataaaattatactattttattagaatgtggtcaataaaatagattttttgcttgaccaaaagcaggaagcaccgtataatagaaaaacatggagatgtactcaagtggtcgtaagaggtcgcactcgaaatgcgataggtccttcgtgggcgcgtgggttcgactcccaccatctccggtgaatggcggtatgacgaaagttgtactgccttttttgttgcgaaaaaattcttgcgaataaaaaaagtgccggtacattttcatgtaccggcaaagagagggagggaaaagaaaaatctatataaaaagttaacttgcttattgggtgaaggccggcagccacaaagttgatttcgttcaaaccttactttcgtaaaacccaaactgcgatgcagccgctgtcttcttcatttgataatgctagtatatcccaaaaatatgatagaattgtgtccgtatcataaaccttttctgaaatttttaaacagagtatgaaaaaaataaaaagcaaccggttgcaatgggttgcaatgaaaaagcactctgttgtataattctaaatcatacagaaataggatgcggagaatgagagacgaagaaaaatttatgaaagaggccattcggcaggcgaaaaaggcgtatgcgcttcgagaagtaccgattggttgtgtgattgtctatgaagggaagattattgcccgtggttacaatcggagaaatacagataaaaataccacttctcatgcggaaatcaatgcaattcgaaaagcaagtaaaaaattaggtgactggagactggagggttgtacattatatgtgacccttgagccatgccagatgtgtgccggagcaattgtgcaggcaagaattgataaagttgtgattggaagcatgaatccaaaagcgggctgtgcaggctcggtcttgaatcttttggaaatggatggatttaatcataaggtagaagtggaaagaggagttcttgaagaagaatgcagtaccatgctgagtggattttttaaagaactaagaatggaaaaggcaaaagcgaaagcaaaagcaaaggagctggaagaaaatgacaaaacaggaatttaaagaactggtagcaaaaggaaaagtggtattagatggagcaacaggctctaatttgatgaaagcaggaatgccaagaggtgtgtgttcagaagcatggatttatgaaaatccacaggcattaatagaattacagaaagcctatgcagaggcaggttctgatattatttatgcgccgacattttctgcaaacagaatcagtctggcaaatcatggattagaggataaagtagaagagttaaatcgaggactcgtaaagattacaaaggatgcagtgggagacaaatgtcttgtagcaggagatgtgacaacgacaggaaagcaggaaattgcttacgaagaactgttagaggcttataccgagcagattcgcattttaaatgatgcaggggtggatttactggttgcagaaaccatgcttggagttacagaagtaatggcagtattagatgcggcagcagcagtctgtgacctgccggttatgtgtactcttaccgtagaatccgatggaagtctgttctttggtggagatatctatgaagcagtagaaagtctggaacagatgggtgcagatgcagttggaatcaactgttcaaccggaccggaccagttagtatcggttgtggaaaacatcagaaaacgagtacagattccggtgattgtaaaaccaaatgcgggtatgccggcaattgatgaaaaaggcaatgcggtctactcgatgggcgcagaggcatttgcaaaaaatatgaaagtattgatggatgcaggcgcagatattgtaggtggatgctgtggaacgactccggaatttattaaagcattaaaaaaagaaatctagaaaagaaaaatgataatcaggtaaaaaggcacttccggaaagattcatttctggaagcgtttttttatgtaaaagaaaattccaatgagagtgaaagcacaaagtacaagttttcctgcctgattataagagtggaaatattgtgccgtcttttgccaggaagcaccggcaaatgctccaagtgtgacgagtacggtattccagatgagacttccgaaggtggtgagaataaaaaatttggaaaaatgcatgtgcgccatacctgcgggaattgaaatcaggcttcttacaattggaataaaccggcagaaaaagacggtataatttcctttgctgtcgaaccattccacggcatgagagacatcctcttttttaaagtgaagcagctttccaagtctgccctctacaattgcttcaagtttgaaaaccggaacaagacttccaatctgataaagcacaactgcgccaaggacactgccaagtgtagaaaaaagaataaccccaatcagattcatatttgtataagtagttagaaatccaccaaaggtcagaattacttctgaaggaatcggaggaaacagattttcaatcagaatcaagagggcaattcccagatacccataatgattcatgatagaaatcatccaatattgcaataaaaaaacctcccctgcaatcatctcttttattctatgatgatacaaagaaggttatgatattctttttttaccgtgcaccgcccatcgagactccttcacggacgttacctctacagttaactcagcccaggcaccctcacggcacacaggggattctgcttagtgctgcttcattcctgacctgacacggttcacagagtcctgttgcgtgagacccaaacgtcaacgccacttatagagggcagccccgcaaagcaagcccctccgtttggcaacacccctgctgtagcggattgcaggtacagggcaccgctaactccccggctgcacggtgataccagtatatcggttttttgcaggtttgtcaatgtaaaaaagaaaagcagagagaactttttggaaaattttaagaaagtgggaataaattagtaatgggaggataaaagtatgtgcgcaaaacttttgttattactattactcgggattttttttgcaggattttctaaagaagaagcagccaaagaagatgcagggattccgaaatttattgtgacggaacaggaatttccgaagtttaatgatttaaaagcaaaagagagtaaaagtcaggtgttttctatctggaatcagacagaagagacggagtgttattatttttggggacaggcaccaaacgatgtagagattgaactgaaaaagaaaggggatttattttataaggggaaaatgccggagaaaaaaatagaactgacaacgttaaatccaggggaaaatatggtatttgaggtaaccgttttaaaagaaaaaaatgaatcgggagaggtggaactgttttttcaaaattcgcattgtgataaaaaataaattagtatataataaaaaatgacaagatcaaaatatcaaaatgctattcgtgtatgtacgataaggtgtttgaaagtaagacttgtaaaaacacaagatgggatgtgatgaatctatgaagcgaattggtctgctgacaagcggcggtgactgtcaggcgttaaatgctacaatgcgtggcgtggtaaaaggtttattcaataatttagaggatttggaagtttatggatttgatgatggatataaagggcttatctacggaaattacagaatgctttctgcgaaggacttttcaggaattttaacacgaggcggaacgatacttggaacatcacgtcaaccgtttaaactcatgagagtaccagatgcaaatggactggataaagtagaagcaatgaaacagacttatcataaacttcgtctggactgtctggttattcttggaggaaacggtacacaaaaaaccgcaaatctgttaagagaagaaggactcaatattattcatcttccgaaaaccattgacaatgatatctggggaaccgatatgacatttggctttcaaagtgcagtcaatattgcaacagatgcaatcgactgtattcacacaacagcggcttctcatagtcgtgtatttattgtggaagtcatgggacataaagttggatggctgacccttcatgcaggtattgcaggtggagcagatattattctgattcctgagattccttatgatattcaaaaaatcgctgaggcagtaaaaaatcgaagtcgttccggaaagggatttactattcttgctgtggcagagggggcaatttcaaaagaagatgcagcactttcgaagaaagaattaaaaaagaaacaggaagaagaaaagaaagtttatccgtctgttgcgtataagctggaatcagaactgaaaaaggaactggatttggatattcgtatcacaattccaggtcatacacaaagaggaggaagtccgtgtccttatgaccgtgtgctttcaacacgtatgggttctgcagcagcaggattgattctgaaagaggaatatggctatatggtaggaattgtaaacggaaaaattaaaaaagttccgcttgcagactgtgccggaaaattaaaaatggtttctccggatgaccagttagttaaagctgcaaaacgaatcggaatcagttttggagagtaatcgaattaagcagtcaggcggactaaaaatatccgcttgacgagcatgcatcattcgcatggaaaagcaagaaaacaggagaagaattaaaatgagctatgttgcgctgtatcgcaagtttcgaccgcaaaattttgaagacgtaaagggacaggagcacatcgtaactacattaaaaaatcagataaaggcggatcgtatcggtcacgcttatctgttttgtggaaccagaggtaccggtaaaaccacgattgcgaaaattttagcaaaggcagtaaactgtgagcatccggtagacggaagtccctgtaatgaatgtgaaacctgcaaagcgatttcggccggtacttctatgaatgtaattgaaattgatgccgcatcgaataacggtgtcgataatattcgtgagattcgcgaagaagtggcatatcgtccggccgagggtcgttataaagtatacatcattgatgaggttcatatgttgtcaaccggagcatttaatgctcttttaaagacgctggaagaacctccttcttatgttatctttattctggcaacaaccgaagcacataaaattccaatcaccattttatcaagatgccagcgttatgatttcaggagaattacggttgatacgatttctgaaagactgagtgaattgatggaaaaagaaggtacggaagttgaagaaaaagcaatccgctatattgcaaaagcagcagatggctcgatgcgagatgctttatctttattggatcagtgtattgcattttatctgggcgaaaagctgacgtatgaaaaagcactcgatgtgctgggtgcagtagatatggaagtattcagtgaactgttaagaaaggtgttagcacaggataccgcaggctcaattaaaacactggaagagttgatagtgcagggaagagaactgggacagtttgtaaatgattttgtgtggtatatgcgaaatctgttgttggtaaaaacttcggatgtaccggaagatgctgtggatgtctcggcagaaaatctggaacgtttaaaagaagagagtgaaatgcttgacacggagacgctgatgcgttatattcgtgttttctcggaactttccaatcagattcggtatgcgtcccaaaagcgcgtattggttgagattgcactgattaaattatgccagccggtgatggagacaaatttggattctttatttgaccggattcgcgtactcgaagaaaagatggaaaaagggattccggttttgacggagtctcaaaaagcgagtactcgggcactgccgcagccggaactgtttggcgaagaagctcaagaccaggaagcagtaaaaccacaaaaagcagcgccggaggatttgcagtatattcagaaaaactggactgcaattgtaagagaaacaagtggtctgttaaaacagatgttaaaagaagctacaccaaagtataatgcaaacagtgatgagccaattctttatattgaatttcacaattttcaggcggaaatctgtaccaaaaatccagataccattccgcttctgaaaaaaattattcgagaaaaaacaggaaaagaagtagaaattcagtttgtgattacgaatacggatttaaaaggtccggcaggacttacaccgatttcggtagatgaactgattgaacaaagcatccagatggatgtcgtagtagaagatatgagtgatgacgaggaggacatataatggcaaaaagaggtggatttccgggaatgggtatgcctggaaacatgaataatttaatgaaacaggcacagaaaatgcagcgtcaggcagaagaaaaccagaaagctctggaagaaaaagaatttacggcaaaagccggtggtggtgcagtagaagtaacaatttccggaaaaaaagaagtgacaaaagtaaaacttgcagaagaagtagtagatccggatgatattgagatgttggaagatttgattgtagcagcaaccaatgaagcgttaagaaaagtagagcaggaatctgctgcaatgatgtccaaactgacaggtggtcttggcggacttggtggcggactgttctaagttttagatactctggtaacttagttgccgagtagttcacgaaaatcaaaagacagaggaatcaaattggaatattacagcagtcatattaacaaactgatagaagaattttccagacttcctggaatcggagcaaaatctgcccagcgtctggcatttcatattttgaatctgccgaaagaacaggtggaagaactctcttcagcaattgtagatgcaaaagccaatgtctgttattgtaaggaatgttatactttaactgaccaggaaatctgtccgatttgcaggaatgaaaaacgcaatcatcatatcattatggtggttgaaaatacaagagatttggcagcttatgaaaagaccggaaaatttgacggggtatatcatgtgcttcatggtgctatttctcctatgcttggaatcggaccggatgacattaagttaaaagagttgcttcagcgtctcacaagagaagaaattgaagaggttattattgccacaaattcaagtgtagagggagagacaacggcaatgtatctgagtaagctgattaagccgaccggaattaaagtcagccggattgcaagcggtgtgccggtaggcggagacttggaatacattgacgaagtaactcttttgcgggcacttgagggcagagtggaattgtaggggtgtaattttatgaggaaaaaagttacatcaacagatatcgcaaaaaaagccggtgtctctcaggcaacggtttcgatggtattaaatcataaatataatgtttctttttcaaaagaaacagtggaaaaaattgagcggattgctaaggaaatgggatatacaatcccaaaacggcgccaaagaaaggagagccggaaagggaagctgattattgtattttgtccaacccttaccaatccgtattatgtcatgctgcttcagggaattgaggcagtggcgaaagaagagggatacagtgtttttacctgtaatacacaaagagaattgaaactcgaagaacaatatctcaagctgatgtcgagtgtagaccctgcaggaattatatatacctgtaatccaagttctgtatttatggaacaggtaggcgagattgcaaagaaaatcccgcttgtaattatcagtaacagggagaaagtacaggttgatgcaattaatcaggataatacaaaggtaggacgtttgatggcaagacatcttttggattatggccacagagatgttgcatttattacacctccgcttacccaacgtcagaagcagcgttccaaacgagtacagggatttgtacaggagtatgagcaggcaggacttggagaccgagttgtgataaaagcggccgatgcgtctttggatgaacagttgccgagtccggattcggaatataagatgggatataatctgacaaaagaacttcttgcagaatatgataatctgacagcgattgcgggattaaatgacatgatggcatttggaatcatggatgcactgcaggaagaaaaatataaaattccgggagatatgtctgtaattggatgtgataatatcatcttttcgggcatgtctcatttgtcgcttactacaattgaacatttcgttccattaaaaggcagggatgcatgtgatattattatccgaaagattaaatcatcaaaagatacttatgatggaacgaatccaatcagtatttatcacatcgagtatgaacccaaattaattgccagaaaaaccacttcttatgcacgggaaaaacgcacgaaagaggcaggaaagaaaagaaatattaaataaaatcagaaaagatattagtaataaaaaaacaaaaaaaggctgtatatagcagaaaaattatgaaatacagccgaaaaattattaataaaatgcatatttataaatgaataaaatcactaataatttttttgtgacttgcccgtaaacgaattatgaggtaaactataaccaacaaataaaacgaacgtttcacgggaggaaatgagttatgaaattttttattgatactgcaaatgtagaggatattcgtaaagcaaatgatatgggaattatctgtggagttactacaaacccatccctgattgcaaaagaaggacgtgactttaatcaggttatcaaagaaatcgcttctatcgtagacggaccaatcagcggtgaagtaaaagctacaacaacagatgcagaaggaatgattaaagaaggtcgcgaaatcgcagcaattcatccaaacatgattgttaaaattcctatgacaacagaaggcttaaaagcagttaaagttctgacagcagaaggaatcaaaacaaacgtaacattaatcttctctgcaaaccaggcattactggcagcaagagcaggagcaacttatgtatctccattcctcggaagactggatgatatttctgtatgtggaacagatttaatccgtgacatcgttgagatatttgaagttgccggtattgatacagaaatcatcgcagcaagtgttcgtcatccaatgcatgtaacagaatgtgcacttgcaggtgctgatatcgcaacagttccatacaaagtattagagcagatgacccatcatccacttactgaccagggtattgaaaaattccaaaaagattatcttgcagtattcggaaaataaaggtaagatgtgagtggcaaaacaaaattgccactcacttatattatgagaaattttttcaggaggaaactatgaacaaattagagcttcagaaaacagccaatgaagtccgcaaaggtattgtgacagctgttcattccgcaaaagcgggacatccgggcggttctttatcagcagcagatttatttacttatttatattttgaggaaatgaatattgacccgaaagagccaaagaaagcagaccgtgaccgttttgtattatccaaaggacatacggcaccgggactttatgctactcttgcaaacagaggatatttcccggtagaggatttaaaaactctgcgtcatatcggttcttaccttcagggacatccggatatgaaacacattccaggtgttgatatgtccagtggttctttaggacagggaatctcagcagcagttggaatggctttagccggaaaaatggacaatgcggattaccgtgtttatacattgcttggtgatggtgaaatccaggaagggcaggtttgggaggcttctatgtttgccggacacagaaaactggataacttagttgtaatcgtagataacaatggacttcagattgacggtaaaattgaagatgtttgttctccatatccaattgataagaaatttgaagcattcaattttcatgtaatcaatgtagaagatggaaatgattttgaccagcttgcagctgcatttaaagaagcaaaagaaacaaaaggcatgccgacagctattatcatgaagactgtaaaaggaaaaggcgtttcctatatggaaaacaatgcaggatggcatggaaaagctccaaacgatgaagaatatgcaatcgcaatggcagacttggaaaaggtaggtgaagcattatgtcagaagtaaagaaaattgcaaccagagaaagttatggtaacgcattagttgaattaggaaaaaaatacgaaaatttagtagttcttgatgctgacctggcaggtgctacaaagaccggaatattccaaaaagcatatccggaacgtcacattgactgtggtatcgcagaatccaatatgatgggaatcgcagcaggtctgtctacaacaggaaaagttccatttgcaagtacatttgcaatgtttgcagcaggacgtgcttacgagcaggtgcgtaactccatcggttatccacatttaaatgtaaaaattggtgcaactcatgccggaatctctgttggagaagatggtgcaactcatcagtgtaacgaagatatggcgcttatgagaaccattccgggcatggtaatcttaaatccatctgatgatgtagaggcaaaagcagctgtagaagcagcttaccttcatgaaggtcctgtttatttacgttttggacgtctggcagtgccggttatcaatgacagaccggattataagtttgaaatcggaaaaggtatcgtgcttagagaaggaaaagatgttacaatctttgcaacaggtctttgcgtaagtgaaactttagcagcagcagaaaaactggctgaggatggaattgatgcaaaagtaatcaatattcatactatcaaaccattagatgaagaactggttgtaaaagctgcaaaagaaacaggcaaagtcgttacagtagaagaacattctgtaatcggtggtcttggcggtgcagtagcggaagtgttaagcgaaaaagctccgacacagatgcttcgtatcggtatcaatgatgtatttggtgagtccggcccggcagtaaaattactggaaaaatatggaattgatgcagcaggaatttacaataaagtaaaagcattcgttaaataattatatttacaaataaaaagctctgttatagaatagggctaagtcttagaggtgtcgccaaaaggcggcacctttttttagttcttatggctaaagtttttaagaactaaaaaagaaagggaatgaagttatgaaaacgagaagcagaagaacggtaaaaaatacaagaaacacaggcggagaggtcagacaggataaaaaatccgaaaatgaagaattttatggatatatcaaagatttggtacatcatccgtatgtcctgaaaatgaaaaattatcagcatcattgtaatacaagttgttatcagcattgtctgaatgttgcctattacaattataaaatatgtaaattttttaatctggatgcacgttctgcagcaagagcaggtatgcttcatgatttatttttatacgactggcataatcatcgcaaaaaaacaggtgaccctgttcatgcaatgacgcatccgcatactgccctgcataatgcgcaaaaatactttaaattaaatgcacttgaaaaagaaatgattttaaaacacatgtttcctgtaactccgattccaccaatgcataaagaaacgtggattatcacattaacggataagtactgtggaacatgtgaaatcggacagtattattttcatgtatggtttccgagaggtgtctatcacgcaatgaaacacctgatgaaaaaaatatttggcaaggactatacttatgcagattaccggcttccgttcggagaattctccgaagatgctgcagacagaggggtaaattttgcaaagcttcgaaaacgttcggaatctgaatccgaatggaaaaaatccaataaagaaaaacgatgtgttccgaaatattgacggtgtgcaatcagaatgccggatacaattgtgtctgcaagctgaatcacggttgcaagtcttgttgtctgaagtacaaaatgttcaaatgcccctgagaggtttacaattccagtgatggaaatgtcgccgaccgggggcagtttcttttttacaccaagtccgggggcaagtgcaccttttcggatggtgacaaattcctgatgtcgttttgagccaagggaggcatcaattgcaatcaaaagacagttcggatgttttgcatgaaccattgctgtgacttcagcaaggtttaaggcatgaacgggctgatccagtgtcccataaatgatacagcgggaaagatgttctttacttaatttatgtccgattaacggaccaaggctgtctcctgtaatccggtcacttccaatgcagagaaagactacttcctgaaaatctttttgctgtgagcacagcatttcaaataaaagagaaccgacctggttgggagcgcggcagcttttgctttctacatagtggacaggagcattttggtatgattccataaaatttaccatcctttcaaaaaaatcactgttttagtacagcgaatattaagtaactgctagattgacgctgtactactggtcaaaatttcttttataataggtttccctgttttggatgatttatcctgactttttaagtaaagatttgtcgacaaaaaaaatcaggcagcttcctcaaagtgataaaatttgcagagcttgtatgctattcttttgcccaaaggggtgaaagaattatgatagaggtcatttatgaaaaggagaaagaaaaagcggagggaaatcaggcttttttccggattccaaacaatatacgacagattggtgaaatacagggaaatcaaaaaatctatatagaagattatgcttatacttatctttgtagaatcgcaagtgaggattctgcaaaagggagagcggcaattctgcttgggcaggcgaactggaaagatggaaagacgtatttatttattaaaagtgcggttgcgcttcatgatattgaggtttcagaagaacattttgcctttacaaaggatgtgtggaaacagatttatgaggaaaataaaaaattctttccgaatcaggaaattgtaggctggtttttatcgcttccaggctgttctatggaacttcatgagggaatcagcaaaacacattttaatcattttggcggaaatgaaaaagtgcttatggtgatggaacctcttgaaaaagaagaggctttttatcgttatgaagaggggaaacttaccaggcaggaaggcttttatgtttattatgaaaaaaatgagccaatgcaaaattttttaattgagcaaaataaatatgcaagagaaagaagcgaaaaggtagcggatgaagcagtaaagacatttcgtaaaaaagtagaagaaaagacgaaaggaaaaaagcgggataaaatagcgcctctgtttcggatggcaagtgcaagtgcggcagcagcaatgttgattgcgggagtactttatctgaatcaatatgagaagttaaaaaaaacgaattctattgcagacaaagcaaaaattgaaaaaaagaaatccgaaacggttgtgtcaaattcaaacaacgatgcagaaacgatagaaaaatcagagacttccgatacagaaaagttaaaagaagagacacagactgggacagagtcggattcagtatcaggttcaatggacggtaaaagagataagaaatcagaacaggcaaatgcaggggcggaagggaacaagcagagcgaatctgcaagacaggaacaacagggagagacagattcagataggacagaaagtgcaaatacagcacagggcacaggaaatacaagtatagcgcaaaccacaggttcaaattcaatgcatgaaacatataccgtgcgtgagggggataccattaccagcatcagccgggcttattatgggacaacttcaaaaataaaagagatttgtgaattgaatggaattttcgcagaagaatttatttttccgggacaaaaaattttactcccgtagaaaagtgtgctataatagccgcatgtcagggcataagcgctttgatataaatagtggactcacaaaatcaagcacagaaagattctgagagtacataataaaacaaaggttaagataaatggaacagaataaagaaaaacaaagtcaaagcaaaagcaagggtaagaaacaaacaagacaaaccagagaacaacgcagacaattagagatgattttagtaggcattttgattttaattgtaattattgtaatagctgtattagttattcacaggcgtacgtatcacaactattctgtactttcgtcttcaaaaaatgaaaatgtgcaggcttatggttttgtccagtttgaagatgaaattttgaaatacggaacagatggagtttctttggtaaatcaaaaagaggaaacggtatggtcagaggattttcagatgacaaatccgacagtagacgtctgtgaaaacatggcggtggtagcagacaaggatgcgacttctctgtatattttatcaaaagaaaaagtggttggaacggttcagacatccaagccgattttaaaagcaagagtggcgagaacaggagttgttgctgcaattttacaggataatgacaaaacatgggtagatttttatgccaaagatggcagtctgattgcggaaaaccagacaagaattgacagtccgggatatccggttgacattgcagtatcaccaaatggaaagattattatggtcagctatctttatgtagaagatgcgcagacaaccagttatgtagctttttataattttggagacagcggtcaaagtgaaattgacaatattgtatccggttacacttataaagatgtcattgtaccgcagaccatttatttaaaagacggttctgcgctggcatttcgagataatggattttctgtctatcagggagaaaacattccgaaagaagagaaaaatgtggaaatgacatcagagattgtcagtacattctataatgataattatgcaggagtggtattcaaagataaagataataataaaaattatgtaatgcgggtatacagtctgaatggaaaaatgaaatttgaaaagaagttcaatattgaatatacccagataaaaatcagcaatgaaatgattattatgaataacgatacgcaagtttgtatgattgacttaaacggaaacaaaaagtttgatggaaactttggagaggggacaatacaggggattttcagaattgcatccaatcgttatatggtggtttcggaaagtggaatcaagacaattaaattaaaataaaatatgtggaaacaggcggttgtcggcaggcaatggtctgttttctctgcattatgggatagatttaagcgtagcgtttaaaatatggaaacagaatggtatttaagtaagaggctcggttccttatagtcgggtagctcacgaaaaaatcaaggaaagaaacaaaaggagaaaagcgtatgaactggttaagcatagtaattttagtgatactggcagggtgtattttaaatggttttagaaaaggaatggttcggacactggcagcaatgatgtcgcttgttgtgagtctggtgctggtatcactggtaaatccttatgttgcaacatttctggaagaaaaaacaacggtgtatgaagtaactgaaaccaaatgcagggaagcatttcaaagtattgccgaaaaacagacggaaaatgtgcagcaggaatttatgcagaaaatgggtgttccggaaaatttttcaaatacacttagaatcggagatgagtttacggaaagtgcagtggctccacttgcagagtcaacggcacatctgattgtaaatggacttgcttttgtgattacatttgtgctgttatcgattttgcttcggattgcagtggggctgctggatggtttattcagactgccggtcttaagcatggtcaatcgtcttgcaggtggggcaataggcgcagttcagggattggtgattttatgggtattctttttgattgtgtttctaatctggaatacagaaatcggagcacaggcattggcaatgattcaggaaaatctagttataaactggctgtataactgtaatccgtttgtaaatattttattgaaataaaaagaaagaagaaagctatggtaaggataaaagatattgcaaaagaagcgggagtcagtccgaccactgtttcgaatgttatacatggaaatacaaaaaaagtttcaaagtcaaatattgataagatacagaaaattttggaagaacatcagtatattccaagtatgagtgcattgatgctggcgcagaatcgttccagactgataggtgttttgattggcggggtagatggaaaaagaagaagtattgaaggtgacccatttaccagcattatgttaagcgcacttgaattagagatttacagaaaaaattattatatgctgtttcacatgtcgagtacatcggaagaaagctggaagttggcagcgacgtggaaagtagagggtttgattacacttgggcttacagcagaacagaatattgaacttcaaaagaggtgtcagattccattggtcagtattgacaattattatgagggaagagaacgggcagaaaatatagggcttcaggattttgaaggaggttttaagatgggaaattatctgatagaaaatggaatgaaaaagattcttttcctgtcagataatgatattggcgtagaccatgagcgttggctcggacttcaaagagcagcaaaagaaaatggttcagttttggcgaaacattggattatgccgataaagcaggaatttcagatgcagtggttaaaagaccagttggaagaaatttgtaaatgggatgcattattttttgcttcagatcgttatgcacaggaaggaattcttgtgttacaggatatggggattcgtgtgccggaggatatttcggttgttggatttgatgacagtccttatgcaaagatgtgcagaccacagcttacaacagtgcgtcaggatgtcatgaaaaaaggaaagatggttgtaaagaaactaatgagtctgataaaagaagaaccatttgatggagaagaacggcttccggttgaactggtggttcgtgattctgtacagaatagagaataagatttaggtgaaatggacgttttgcgaaaaacctattgtgatagaaaacacagtttgctataattggtaatagtaaataaggttttacgcaaaacgtttttgcgtaaatgaaagcagataattattgctttgaatctatatatcagatttatatagcaaagtgagaaaacgtgtctgatttatcagaacgattagaaaatggatgaggtgaagattatggaaaaaaaatggtggaaagaaagcgttgtttatcagatttatccaagaagttttaaagacagcaatggagacggaattggagatatcaatggaattacagaaaaattagattatttaaaagaattaggaattgatgtaatctggctttctcctgtttatcagtctccgaatgatgataatggatatgatatcagtgattatcaggcaattatggaagagtttggaacaatggaagatttcgaccgtatgttggcagaagctcataagagaggaatccgaattgtcatggacttggttgtcaatcatacatcggatgagcatgcatggtttgtagaaagtaaaaaatcaagagaaaatccatatcgtgactattacatctggagagaagggaaagacggaaaagaaccaaataactggggttctgtatttaacggttctgcctgggtttatgatgaaacaacggatatgtattatctgcatctgttttctaaaaaacagccggatttaaactgggataatccaaaagtccgtgaagaagtcttttctatgatgaactggtggtgtgaaaagggaatcgatggtttccgtatggatgttatcagtatgatatcaaaagtagaagggctcccggatggaaaagtgcagggaggtctctatggagatgcttctccttatgtacaaaatggtcctcacgtacatgaatatctgcaggaaatgaataaagaagtactttctaagtatgacctgctcacagtaggagagtgtgcgggtgttacaattgaagaagcgaaaaaatatgcttccaataaaggaacagaacttggaatggtattccagtttgaacatatggatttagatcagggcgaattttcaaaatggagcgataagaaggtcaagctgaccgctttaaaagaaaatttgacaaaatggcagaacgaattagaaggaaaagcatggaacagtttattctggtgcaatcatgatcagccaagagttgtctccagatttggaaatgacagtaaagaatatagagaagtttcagcaaaaatgctggcaacctgtctccatctgatgcagggaacgccttatgtatatcagggtgaagaacttggtatgacaaatgttccatttgcgtctgttgatgaatttaaagatattgaaagtatcaatgcttatcatgaatacgttgagagtggattgattagtaaagaagatatgatgcgttacctttgctataagagcagagataatgcgagaactccgatgcagtggaatgctcagaaaaatgcaggatttacaacaggaacaccatggattaaggtgaatccaaattatgtggagattaatgcggaagaagaagtaaaacgggcagattctgtcttctcttattataagaaattgatcgcattaagacatcaggaagaagtaattgtgtatggtcattatgaactgctccttccggaaagcgaagaattgtatgtttatacaagagaattaaatgaagaaaaacttctggttatctgtaactttacagataaagaggtttcttatgcggttccggatgaatttgttggaaaagaaatcctaatcagcaattatgaagaacaggaaatcaaacaagaactgagtctgaaaccttatgaagcaattgtagttagaagatagcattttgtttgtataaagcaggtgaaataagacgcacagatagtggaaggtactgtctgtgcgtcttacatttactgctgttttaatagtagtaaatgcttggaaattcatagaatctaggatagtagaaaaaaattgaaaaaaagtgaaaaaagctgttgacaaatgatgaataatgatgatattatataacacgaattgttgattcgttgttaaaatagttttaaaaagtttaaaaaaataaaaataaaaaaactattgacaagctgataaagatatggtattctattaaagctgtcgcagaaaacgacaacaaatcaaaaattaaaaactttgaaaaaagttgaaaaagttcttgacaaacaaaaacagctttgatataatataaaagctgtcgctgataagaaagaacgacaggaaccttgataactgaacagtgaaacacatgaaaacgaaaattcttttacattcatttattttaaaaagaacggttcaatgaaccaaaacagtaaaagggatagatagccaagtagttatcttgaacttggacaaacactatatcagagagtttgatcctggctcaggatgaacgctggcggcgtgcttaacacatgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacagtatcgcatggtacagtgtgaaaaactccggtagtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctattgtcagtagccagcaggtagagctgggcactctgatgagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttagggagggagctgccgaaggcgggattgataactggggtgaagtcgtaacaaggtagccgtatcggaaggtgcggctggatcacctcctttctaaggaagaagaagtagtcgtaagtgtttcactgttgagttatcaataaaaaacagataacaacatatttccggtggcgatgcgcttaggggagacacccgttcccatcccgaacacgatggttaagacttaagcggccgatgatactatgctggagacggcatgggaaagcaggtggctgccggattacaaaagagggcttatagctcagctggttagagcgcacgcctgataagcgtgaggtcggtggttcgagtccacttaagcccactgggtgatacccagaggaaaaaagtaaatatggggatatagctcagttgggagagcacctgccttgcaagcagggggtcgagagttcgaatctctttatctccactcggtaagaaaacgaaagttttactaccgtagtcgtaccttgaaaactgcatatacgaaacatctaaaatacgtaaaacgtaagatagagacgaaacgaggcgctgtagaaatacagcgatgaaatagaaacaaaccaagcaacaccagccgtcagatgttaacgctataagatctgaatggccaagcaaaaaagagcgcagggtggatgccttggcactaagagccgatgaaagacgtgataagctgcgaaaagcttcggggaggagcaaatatccaatgagccggagatgtctgaatggggaaacccacatgagaagacctcatgtatccatacgccaatccataacgtatggaggggaaccgggggaactgaaacatctaagtaccccgaggagaagaaagaaaactcgatttcctaagtagcggcgagcgaacgggaaagagcccaaaccagtgtgcgtgcatgctggggttcggactgtataattgattccttgattctaccagaatggttttgggaaagccagccagagagggtgaaagccccgtatgggaaaggaaagaggacaagacaggatccagagtaccacgagacacgagaaaccttgtgggaaggagcggggaccaccccgtaaggctaaatactccttagtgaccgatagagcatagtactgtgaaggaaaggtgaaaaggaccccgggaggggagtgaaagagaacctgaaaccctgtgtttacaagctgtggaaccgctttatatgcggaaccgcgtactttttgtagaacggtccggcgagttgtgcatgctggcaaggttaagcgctaaaggcgtggagccgtagggaaaccaagtctgaatagggccagagtcagtatgtgcagacccgaaaccgggtgatctatccatgtccaggttgaagctgccgtaagaggcagtggaggaccgaacccacatccgttgaaaagggtggggatgaggtgtggataggggagaaattccaatcgaacccggagatagctggttctcctcgaaatagctttagggctagcctcgatagagatacatggaggtagagcactgaatttcctagggggcgtcaaagcctaccgaagaatatcaaactccgaatgccatggaattgattatcgggagtcagactatacgagataagttggatagtcaaaagggaaagagcccagacctccagctaaggtcccaaagtacgtgttaagtggaaaaggatgtgggatttcgaagacaaccaggatgttggctcagaagcagccatacattcaaagagtgcgtaatagctcactggtcgagaggtcctgcgccgaaaatgtccggggctaaaacacgacaccgaagctgaggaatgtatttgatacattggtagaggagcattgaatacgggaagaagcagtaccgaaaggagctgtggactgtattgaagagagaatgccggaatgagtagcgagaataaggtgagaatccttatggccgaatatctaaggtttccagggtaaagctgatctgccctgggtaagtcgggacctaaggcgaggtcgaaagacgtagccgatggacaacaggttgagattcctgtactgcgttagaacagaactgtggggacacgtgtggaaagcacaacccgggaatggaatcccggggcaagcgaaggaggagtcacataggaaaaaccgtgtgacaatccaaaggcgtgatgcggaccgaactagagtagggaagtgtgtgagccatgcgtcaagaaaagccgctattgtttgtaacgtacccgtaccgtaaaccgacacaggtggatgaggagagaatcctaaggccgacggaagaagcattgccaaggaactcggcaaaatgaccccgtaacttcgggagaaggggtgcccgtgtaaaagcgggccgcagagaataggctcaagcaactgtttagcaaaaacacaggtctatgcgaaaccgaaaggtgaggtatatgggctgacgcctgcccggtgctggaaggttaagaggagatgtcaggaaacgaagcattgaatttaagccccagtaaacggcggccgtaactataacggtcctaaggtagcgaaattccttgtcgggtaagttccgacccgcacgaaaggcgtaatgatttgagcgctgtctcggcaatgcatccggtgaaattgaagtaccagtgaagatgctggttacctgcgccaggacggaaagaccccatggagctttactccagtttggtactgggattcggtattgcatgtacaggataggtgggagactgagaggtagtgacgccagttgctacggagtcgatgttgggataccacccttgcagtattgggtttctaaccagccgccgtgacccggcggtgggacaatgccaggcggggagtttgactggggcggtcgcctccgaaagggtatcggaggcgcccaaaggttccctcagaatggacggaaaccattcgaagagtgcaaaggcagaagggagcttgactgcgacaccgacgggtggagcaggtacgaaagtagggcttagtgatccggtggtattaagtgggaatgccatcgctcaacggataaaagctaccctggggataacaggcttatcactcccaagagttcacatcgacggagtggtttggcacctcgatgtcggctcatcgcatcctggggctgtagtaggtcccaagggttgggctgttcgcccattaaagcggtacgcgagctgggttcagaacgtcgtgagacagttcggtccctatccggcgtgggcgtaggatatttgagaggagctgtccttagtacgagaggaccgggatggacaggccgctggtgtatctgttgtagtgccaactgcatggcagagtagccaagcctggaagggataaacgctgaaggcatctaagcgtgaagcccccctcaagatgagatatcccattcgtgagaagtaagaccccttgaagacgacgaggtagatagggcagaggtggaagtgcagcaatgtatggagctgactgctactaatcggtcgagggcttgaccagaaactgagaaatcagtggagcggcaagtgtctgcatggtttcggttttgtatatgtagttttgaaggtacgatgaatgaatattcctccttagctcagtcggtagagcatgcggctgttaaccgcagtgtcgttggttcgagtccaacagggggagcttgttttaaataacataaatatccatggctccatggtcaagcggttaagacaccgccctttcacggcggtaacaggggttcaaatccccttggagtcactcaacagaatatgttgacaaactagtctataatatgttagactaaaaacgtgccgatgtggctcaattggcagagcagctgatttgtaatcagcaggttatcggttcgagtccgatcatcggcttcatggacctttagctcagttggttagagcaaccggctcataaccggtcggtcctgggttcgagtccccgaaggtccatcgctaaaggttaaatgaaataataaaatagaataaggcccagtggctcagttggttagagcgccgccctgtcacggcggaggtcgagagttcgagtctcttctgggtcgtttcgagtaaatcactcgatatgccgcagtggcggaactggcagacgcccgggacttaaaatcccgtgggtagtgatacccgtaccggttcgattccggtctgcggcattaattttttgcttcaaattcagtaaggatttggagcattttttcattttgtaccaaatttgtaccttgttctaagaatacacatcattctaatatctctcaatctttgagtggaaaaatcccaattatttttaaatttcatacaaaaaggcttcaaaaactgtaatcctttgttataatatttttaaagaattaaaatagagaaaggaagcgaaaaaagatgaagatttgtccaaaatgtggaaagcggtatgaagaaaaccaaaatttctgcaaaacttgtggaatgcgtctggtagaagaaaatcagcgcccatcaggaaatccgccagtaaaaaagaaaagtcatatcggtttatacataatgattgtaatctttgcaatctgtataggtgcaggtgcttttgcagtggttaaaatttctgataataaaaaacaggaagaagcagagcagagtcaggtcagtaagaatgataaaagcacagacaaagccgatagtaaagatgtggaagagaaagattccagagaaacaaaaaaagatgcagaagaagatgtagagccggttgaaggaactatgaccgcagaagaaaaggcaaaagcagaagaaaagaaacaaaaagaagaagaaaagaaaaaagaagaggaagaacagaaagaattattaaagaaatacgaggaacaggaagcacaggaggcagaagcagcgaagaaagcagaagaagaaaagaaatcccaggaagccgcttcaaacagtcagagtgcttcaacaagttcatcaagttcaaccggcagtagtaccgacaacagtctttatgcaagctggagtgaaaaattagtgggagcagaacaaagtgatacagccattttaaatgaagtaggtgcttcggatgactttaatacaaagatggcaaaacaggaagcacgttatcagttatgggatgggctattaaatcagatgtggcaggatttaaaggcatccttaccggaggatcagatgtcacagcttacaagtgcgcaggtggattggattcatcaaaaagaagcaatgatatcacaatactgggaatctcagaatgtggatcattctggatttaatgaagcaccagcggcagatacaaccaaacaaagagtgtattatctgttggattattgtccaagaagtaattaaccgaatcaagtagtgaagcagatttagaatatcaatatctgcttcactccaacgtaattacagttctaatgatgttagaatcaaagagggaggtttggatatatgttttgtaaatattgtggtagggaaattaaggagggcgaaatctgtacctgtagacagcagagttctaaaactccatatccaaagccggatattcgtccagtcatgcctgaacaggaaaatacgcagagacaaggaataaatcagaatcagggaaattctcaaaatcagggaacgactcagaatcgcagacagcagactcagtttgagagaaaaccggtaaatagaacaccagtaaataaaacatcaactgcaccacaaaatcagagaaccggaaaaaaagatgggaaaggattggcagttgcgtctttcctgcttagttttttgcttttagtcagctttgttttattaagagttgtattgcaagatttcatgcaggaaagtactatgttggagagtatttatccgtatttaatttatgttgtgccgtttttacttggtctgggagcatttttatgtgcaattttttctcttcaggatgcaagagtgcgtacgctttcgatttccggaattttaatcagtgcgatttttgttgcaggaatttttgtttctaaggtactgtttccttatgaagcagacagctatgtggcttcatcggatagaagtgatgaagaggacgaagaagaagtcggtaaagataattctaaggatacagaagatgcatcgaaagaggaagaaactgcagagtcggattcttctatttcccagattaagagtgattatcaaaaaggaacacttgattatgcaggcgtaaaaaatgcgttagtaaaacttgatacagataaattggaatcaaaagaagcagaagaagttttagcacttcaggagcagacggaaaaagatttagaggacagtcttgaaaaatccgcaaaaagttccgattatgaaagtattttaaagaaactttcaaaacaaaaagaagagttaaaagacgaggatgagcttatcacaaaactgagtgaaaagtatgaaccagaatatattttgtatttagatacagagagcaagaatctgctggcacagggcaaaaaggacgacgcattaaaattattaaaaaatggaaaaacattggtggaagataccgatgcggtggataatttaattgcggaagcagaagagggagtaaccggaggagattatattttaccggaaagtaacagcagatatcttacagatgcagatgtcagcggattaacgcttcagcagttaaattatgcgaaaaatgaaatctatgcaagacatggaagaaaatttgattctaaggaactccagaattattttggaagcaaatcatggtataacggaacggtcaatgcggctgattttaaggaaacagtgtttaatgaatatgaaaagaaaaatgcagaatttttaagacagaaggaatttgcaatgcatgatggaggatatcagttagaccagtaagaaagagtgaggagaagaaagatgaagtgcattaattgtggatgtgaattgccagagggagcaagattttgcggtaattgtggagcaccacagccggagcatcaacaggaagaacagcagtcaggacaacaggtgcaacaaagattttgtcctcattgtggaggagcgaatgatgccgatgctgtattctgcagtatctgtggaaaggatatgaatggggacggacaaccggtggttgaagaaaccatgtcaaagaaagttctgaaaaagttaattgtgggagcagtaggtgttgttgcggcagttgttgttatcggcggagttgtaaaaatcgttggaggactgggaggcagtaaatccgattcttacatcacttatgtaaaagatggttatattaatcagtccgatattgaacattataagaaaaaaccagtagagtatcagggaagatacggaagcacaagtgatgatggagagaattattctgccggtgtgagttactccaaagatggaaaatacatctgttatcctacagatgtaaattatggcgatgatggtatagaatttcgtttaaatatgcagaaagtaggaaagacagaagagccggttaagattgacagttcggttacaagttatacaattttggacaataataaaattttgtataagaaagccggaaatgatacgctttatattaatgataagaagggaaataaagaaaaaattgcttctgatgtcaactatttttatttagacagtgaccagaaaaatattgtgtggagcgaatcaaacggagatggcacgattaacgtctgccagcaggatgttgcgcttaaaaaagagaaaaaaacgttggcaaaagacgtggattctttctatgcaagcagtgatttaaaatatgttgtagtccaggaacaagatactctttatatggtggaaaattttggagaaaagcaaaaaattgcttcgggtgtagaagatgtttcttacgatggtttagataatggaggaatctattacacaaaaagttcagaggaaacattaagtgcagaagatgtggttgaagatgactgtgcagacagtgatgcaacgattgaagagccggatagagaagattataaagttgaaaaaatcgagaaaaatgactggaccggaaaatacgaaaaagtagagtctgtagatgaagatgcttatgatgcggcttatgaaaaatattatgacaaagaaaatcgagatgaaattcgtgacgcattagaggattatgaaatttctacaccagtggaaaaattgtattatgtaaaagatggaaaagaaacacaggtagatgctacagttgcacagatgtattattatactggagactggaagggtattgtgtatagccgttataatatggatgatgttccgaagttaaaaatttctgagattgacagtgccagcagtattgagtctgattattatcagatgctttcagaatccgcacagacttgtgtgtatacagagaaagacaaaaccgttgtattggatgaaaatcttgcgactgtatggggcgtagatgcagattctaaaaccggatatggagtaaaaatgcaagattccggttcagaagatgaagacgcaacctataacttatattcattctctgtagataataattcagatggaaaatgtaaactgatttccgaagatgtggcatattatcaggaattaataaaagatggagatgtgtactatctgaaagatacagacagtgacggaaatggtgatttatattgtaacgacaaaaatattgattctgatgtaaaatccggaacgctttatacagtgccagattccgataatgtgctttatgcagttgattacaacagttcaaataatagtgcaactttaaaaatgtatgatggaaagaaagacaagattattgcagatgatgtctattcttatcttccaattgatgaaaaacatattgcacttttgattgattatagtatgaagtcttatcgtggtgacttacaatattatcttggaaaagaagaacttaagagcattgatgaggatgtcagctttatttttggcggaaaagagatttattaaaaaaatttattagaataaaatttacgagagagtttagaaatcagggagtttaatttgtgaaacggatgtataaaatcatactgggatgcctttcaattgtcttgattttactaattgttgttgcgctttttcaattaaatcaggtaaataaaacaagacaacaggttactgcggtaagaaaagaaatcagggcaattaagaaagacatagaaaaacaggaaaaagagcagaagaaggcagaaattctgcaaaaagaaacaaaagatgcagagcagaaagaagaagcggataccgatacaaaagcggaagaatcagaagagcctgcagaatctgtagaaacgcaggaagaagcgcagaaagaagcaaaagaaccggaagctggggaagagcagaagaatcaggaaacggatgccaattcacaggtgccagagaccggtaatggaaagaaaatcgcaattgatccaggacatcagggttacaatgtagatatgagtgcacaagagccaatgggtccaggttcaagcgaaatgaaagcaaaggcaacgacaggaacacagggaagttttaccggtgttcccgagtatgagctgaatttaaacatttcaaaacagcttcgtgaagaacttaaaaaccgtgggtatgaagtgatgctgacaagagaggacaatgatactgcaatcagtaataaggaacgtgcagaacttgcaacacagtatggagcagatatttatgtgagaatccatgcaaatggaagtgatgacagcagtgtcaatggggcatttacgatgattccgtctgcacagaatccttatgtcggagcactgcatgataagagctatgcacttggagaagcggtcattaatgcctattgtgaatcttgtaaaattaaaaacagcggagtacagatttttgacaatatgacaggaattaactggagtactgtgccggttattattctggaaatgggatttatgtcaaatgaaagtgatgatacaaatatggaaaatccggatttccagaaattaatggtacagggcattgcaaacggtattgatgcttattttgcagcaggaaattgagaaagagaaatacaataaggaacaaataaaaaatggaaaaaaagaaaaagacaaaggtaattgcaggaatcgttgttttagcggttttgattttagcggttctttgtgtgaacgtatatctgaaagaaaaacagaatactcagaatacaaaatatacagaagcacaggaagaaaagaaacaattagaagaaaagcagaaagcactgaaagaaaagcaggcagaagcagaaaatgccgaaaatacaacgcaggagcaacaggattcagatgaagccggagagcctgtagatgaaacagaagaagatgcggattctgaggaaagtcttacagaagaacagcttgcagaagaagatgctcctgatttggaagcaattcgtgcgtcagtggaagaaaaactgcaaggtacagatgaatttggagaggcatggcagatttatgtgtatcgtttgaaagatggcgcaagagcatctcttggtcagggaagattgacagcggcaagtttaatcaaactttatattatgggcgcagtttattcttcttatgataatatcgctgctgcaaatggacaggagcaggtagataagctgttaaatgcgatgattacagtcagtgataatgattctgcaaatacactggttggaatgttgggaaatggtgataatgcagcaggtcaggaagcagtcaatacttattgtaaaaataatggttacaccgatacttccatgggaagaatgttgcttgaaaaagcttctgcgaacgaaaattatacgtccgcaagagattgtagtgtgtttttgaaaaatatttatgaaaataaattagaacattctgaggatatgttgaatttattaaaacagcagacccgaacagaaaaaataccaaaaggtattccatctggagtagaaacggcgaataaaaccggagaattagaccatgtagaaaatgatgcagcgattgtatttgatggagaaaatccatacattatctgtgtgatggcagataatttaagtgatacgacggaagcgagacagcgaattgttgacatttcttcggttgtttatgagaatatttcaaaataaaaagagcagacaaaaaggatatcgaagtcaataagttttggctaagatatccttttttgctggtttgttttgaacaagaaattatttttggcagattattttctgtaaattattttctgcggaagcggttcaggcaggcataaatttcctgttttcgtggcatggcaagtccgcaggaaagataagaggtactgttgatgccggagaagccttttgtttcgagaatagaaatcaattttttagcaacttcatccaaagtaagctgattgtcaatcaaagattcacaggcaaaacggagcatagatgcaagcgctgatgtctgttcaaaatctgcaagctgttccacatatcgtaaatcaacggtttcttttccaatcgaaaaggtatatcggtcgtgtgtttttacttttaaacctctatctgcatgagaagcatgaggatttcttgaagtttttgtttgaaaatccggtgtgctcatgattcggtaactgtcaggctgatgaaattctgtggcagaagttttcggaagcggattttctttgcacagtacttttgtagaagtcgtaatatcgattgccttatagcagtccatttgaataatagtgtctgcgatatgaaagaaagcaccactgcttccggctacaagaatggtggaaattcccgctttttcatataaatctctggcacgttctaagaaaggagtaattggctctttacttcgaccgatgactttttgcataaaagagtcacgaaccatgaaattagttgcagaagtgtcctcatcaataaagaaaagagaacttccggcctccatgctctctacaatagcagccgcctgagaagtactaccactggcgtcacaggtagaaaaacaatgagtatcttttttatttggtaaatcgttaataaaaagggaaatatccacatcttttatgaaacgtccatcttcagccctaagttttacgccactgtcatcggagattacatattctcgaccatcgcctgcgatatgattatagactccgctttctaaggcatttaataaagtggattttccgtggtagcctccgccgacaattaaagtaattccttctttgatgccgagtcctcgaatcgttcctttgtgtggaagcgtaagttcaatggcaagagaatccggagcaaaaaacggaatactttcttttaaaggtttatcggaaacaccactttgtcttggaagaatagaagcatcggcgacaaaggcagtaagatgaaggcgtttcagttctttacgtagaaaatactggtcctcagcgagaaaataaacctgttctaccactttagtgttctgattgcggtagaaaaatgctttttctacacagactggaagaaaatcaaaaaagattttttctaattctatagaattgatacgtctgccgtttgcgggaaatccaacaaagaaacgtgcaatgatagaattttttgtgatttggcaggcacttcgctctaaaatctcctgaccgcagtgtgtgacagaaatcagaccgctttttccagaaccttttgcacggaaactatagcggtttacctgctgttcaaactggcgggtcagatagtcctgcagtgcaatgcgggtgtaggatttttgatagtaatcagcagggaatccggcagtttttagcggaatctcaacgctgatactggatggagaggcaaatgggtctccctgaacatggtcaatgtataaaagatagtttggaaattgataagtgccacgtaattctttataggcaggatagcctttttgatgaattgcgtggagtttggtctgtaagtcatttgaagtttttggcatagtaaaaaacccctttcaaaattataaaaatctaggattactatagcgaaaatacagagaaatcgcaagtttcgcaaaaaataaaaaaatttcaaaaaaagggttgactttttggaatatgtacattataataggttttgttgttgaggcaatacaaaataaataagaaatatgtgcgtttagctcagctggatagagcgtttggctacggaccaaaaggtcgggggttcgaatcctctaacgcacgctagtaaaaaagtagacagggtataaaaaccctgtctatttttttactagcgtgcgttagaggattcgaacgggttcgttctccgctccgctccggtcgttgctaagcgcatgccacaggcatgcagcaacctctaacgcacgaaagcaaaggggaacgttatctctgatttgtttttgcttagatttgagtggactcgaacgggttcgttctccgctccgcttcggtcgttgctaagcgcatgccacaggcatgtagcaacctctaacgcacgaaagcaaaggagaagagtgtacaaaaaaacggtctacttttttacacttgcagaacatgtaatctgttgatataatacaagttaattgtttaaagtggtaaaatcaaggagaaaagaaaaatggaaaataaaaagttgtttgattataatatttttttgattggatttatgggatgtggaaagtctacgatagcgggatatttgcatgatacattttccatggatgtggttgagatggatgatattattgcacaacaagagggcatgagtatttcagatatctttgaaactcatggagagcagtatttccgtgatttggagacaaatcttttagttgaaatgcagaataagtctaatgtagtgatttcgtgtggcggtggtacttcaatgcgtgaaaataatgtgcttgagatgaagaagaatggacgtgtcgtgcttcttactgcacaaccggaaactgttttgcagagagtaaaagacaatcatgaccggccattgcttgaaaataataaaaatgtatcatttattgcagacttgatggcgaaacgaagtgagaagtatgaggcagcagcagatatcattatacagacagatggaaaaaatgagcaggaaatctgtgaggaaatgattcagagacttcgtgtgatggatgaaagtagatagaaagcaggtggctgtagttacaagcagccaccttatattttacaggcttttatgaaggatatccaatacttgtttaagctcatttactggaatttgtcctggggcagaagcttttgtggcagctccaaatgtgagggcagagccaaaggcttcaccggcaagacggctgatgacacctgttccagccattgacatggtaataatcggacggtcggcgtaagactcagtcatttcaagagttgcatcaaggagcataagcacatcacgtctgcaggttggcatgactgcaatttttggaatatccgcatcaagttcctgcattttacaaagacggcggattaattcttctttttcaggagttttatcaaaatcgtgattggaagaaactacttttacattaaaatcgtgagcttttgagatgatgttcgtcacaatttcgtctcctgtaaaagcttctacgtcaatcaaatcaacaaagccgcttttggcaactgcgagattaaggttttgataagcttcatttgagatggctttttctcccccttcttttgccgtgcggaaggtaaaaagaattggtgtgtcttttaagacagtgtttaattcttttgcggtttcgagtactttatcggtatcaaaaacatcttcgtaccagtctgcacgccattctacaacgtcaatcggaaattcggcaaaagaacctgcttccgtgagaatttcttctttggtttgtccaacaatcgggacacagattttcggtcgtccctctccgataataacatttcttacttgaactgttttcatagctaaaatcctttcctatattcaatcagcattgattctacggttcagagttcaaatgcagcagaaccttgaaacattttctggattgtgaaaaatttttctataagttagcataattagttagagcaggtttgtcaattataaaaaagattctcgcagagcgtttttaattttatacgatgagttttttatgaatgcagataagcattcccccgcttcaagtgcgcagagcactaagcggcgggtgagggggatgcttctgtcagtggaagttgaaagctcccactgacagatcgcaaagcgactgcgttcatgagcaagtagcgaagcggattgcgaatgtccgctttacataagaaaagaaaaagtccggatggaatttaattccgtccggattttttgactaaatgaaacaaactttgtggaatcccgaatccaaagatgattccaagtacaattgcacctgcaacttcaaaggtttcaattcctttggaagaagaaaatgcccggtcattggtaaatagatagtaggcagtgtaaaagattccagctccaggcacaagaggaaagataccggttaaaagatagacggtaacaggagtggagcggatgactgcaaagattcgtgccaaaatcgtaaggcagaaagttgcaatcagggatgggacaactacgcccatgccaagctggactaaaatgtagtagagaatccatccaaatgcgccgctaaaaccgcagtaaagcagttctttttttggtgcggaaaaaaggactgcaaaggaaaatgtagcaaagcctgctacaataaattgaatgataaattctataatagattctataatagattccatagcttagagtcctccgaaataattcataatgacgaatggcagacaggcgccgactgcaatacagatagcggtaattaaggcgtcaagcagatgaattgtacccgaaagataatctgcattataaatgtcacggattgcagtggtaaatgcaattccagggacaagaggcataattgctccgatgatgattttatcctgtaatagattcagattggtcagcatacagagcattgcgagtaaagtgacaaacaggcttgcaaaaatgtttgtgataatctttgaaaatttatattttttcagtgcaaataaaaggagctgttctaaaataccgatgccaaatgtaaaaagagaatcaagggcacttcctccaaataagtaacagaatccggcacttccgagtccgcagaaaaagaccagaagggaattaggataattgggaaggttctgacagcgttccagttcctcccaggaatcaatcaaagaaatcttatgttcgcagatatctctggcaagttgatttaaagcagagatttttccaagatttaccgaaccaagcggaacatggcgcacaatactgcaggcatcttcctgattttcattggcacttgcaaagattccgttggaaatgacgtagacgtcaaattcttttacttcataagattttaaaatgtggacaacagtatcttccacacgataaatttctgccccatttctaagcatactgtcaccgatttcaacagccagggtcagtatttcgtttgtataaaccataataaacctcgttatttcttgaaattattatttaagagaattatatcacatcattttattttgatggaataaaatgagacttgtgatataataaagaatcataggttgtatgttaagaaaaacaaaacctgtcttgaaattataacaaaagatattttataataaagcgaattatctacaagaacaaagaaggagaatgaaaaggaaaatgcttaagggaaagacggttttattaggtgtaacaggcagtatcgccgcatataagattgcatatctggcaagtgctttaaagaaactgcacgcagatgttcatgtattaatgacgaaaaatgctacgaattttatcaatccgattacatttgaaagtctgaccggaaataagtgtctggtagatacctttgaccggaatttccagtttcaggtagagcatgtttcgattgcaaaaaaagcagatgtggttatgattgcaccggcaagtgccaatgtgattggcaagctggcacacggaattgcggatgatatgctgactactacagttatggcatgtaaatgcaagaaaatcatttcaccggcgatgaacgtcaatatgtttgaaaatccgattgtgcaggataatcttaagattttagagcactatggatacgaagtgattcagccggcatcgggatatcttgcctgtggagatacagggacaggaaaaatgccggaaccacagactttgcttgcttatatagaaaaagaaattgcctgcgaaaaagatttaaaaggaaagaaaattttggtgacagcaggtccgacacaggaggcgattgaccctgtaagatatattaccaatcattcatctggaaagatggggtattcggttgcaaaagcagcaatgcttcgtggtgcagatgttacactggtgagtggacgtactgcaattgagccaccgatgtttgtaaaagttgtaccgattgtgactgcaaaagagatgtttgacgcagtgacttcggtgagcgatgaacaggatattattattaaggcagcagcggttgcagattaccgtccggctgttgtaagttctgaaaaagtaaagaagaaagatggagaaatgtcgattgcgttggaacgcacggatgacattttaaaatatctgggagaacataaaaaagaaaatcagtttttatgtggattttcaatggaaacccagaacatggtgagtaattccagagccaaacttgagaaaaagaacctggatatgattgcagccaataatgtaaaagaaaagggtgcaggatttcagggggataccaatgtattgactctgattacacaggaggaggaaacgtcacttccgcttatgagcaaggaggatgcagccaatcagctcctggataaaattcttatgctgacttctaatcaaaattaattctaaataaaagaaaaaggttaaaagattaaaaattaaaaaaaagaggtcagagtaaccacaacaccgtattgtatccgcaaaaggcggaacgagaacaaggaggaaaaatgaaaacaaaaaaatttaccacaacacaacttgccattctgggtctgatgacagctatcttattgattatggcatacacgccgcttggatatttgaacattggaccacttgcgatttcattcaatgtgattccggttgctatctgtgcaattgtgttaggaccgatgggtggagcaattgcaggagctatctttggactgactagctttgggcagtgccttggaattggcggagtcagtgcaatgggagcaatgctgcttagtattaatccatttctggcattcattcagagatttattccacgtcttttcgatggaatctgtctgggatatatttacaaagcgatgagaaagagaacaaatgcttatgtttcctgtgcagtaaccggattcttttctgcatttttaaacactttattctttatgactcttttagtagggctgtttggaaataccgagtatgtaaaaggcttgatgggtggaagaaacatcattatcggatgctgtatgatggttggagtcaatgcagtttgtgaaatgctttcttcaacattgattactggtgcggtaggagcagcactttcaaaagcacgtctgcttccggtagaacaaaaagggaaacgtaagtagattatagaatcataggagaaaaaagatgattttagcaattgatattggaaacacaaatattgtagtaggctgtattgatgagaatgagatttattttacagagcgtctttctacggtaagaacaaagacggaactggagtatgcagttgatttaaaaacaattctggatatctatcacattaagaaaacagagattgaaggctgtattatctcttctgttgtgccacagattacaaatattgcaaaacttgcagttgaaaaaatcttaaaaaagaaagttatggtgctcggacctgggattaagaccggtttaaatattctgatggataatcctggacagcttggagctgatttggtagctgatgcagtagcagcaagtaataattatccggcaccgttgattgtaattgatatgggaacagcgacaaccgtatctgtattaaatgacaagaaacagtacatcggaggaatgattcttccaggagtcggtttgtctttggatgccctgacctcaagagcttctcagcttggcggaattgggattgaagctccgaaacatctgattggaaaaaatacaaccgaatgtatgaaaagtggtatcatttacagcagtgcagcatccttagatggaattgtagaacggattgaagaagaacttggaacagaagcgaccgtggttgcaacaggcggacttgcgaaaaagattattccttattgtaagaaaaagattacccttgatgaagaactgttattaaaaggactgctgattatttacgagaaaaataataaataaaaaaagaaaagtacagaacaaacattcgatttgctctgtactttttttatttggaatgataaactaaaaaaagaaaacactattaacgaaagcagtttttatgaggaaaaatatatggatcattttgaattagtatcagagtacaaaccaaccggtgaccagccgcaggctatcaaggagctggtagcaggatttaaagaggggaatcagtgtgagactcttcttggtgtaactggttcgggtaagacatttacgatggcaaatgtcattgcgcagttaaataagccaactttgattattgcacataacaaaacgcttgctgcacagctttatggggagtttaaggagttttttccgaataatgcagtggaatattttgtctcctattatgattattatcaaccggaagcttatgtgccgtcttctgacacttatattgcaaaggattcggcaatcaatgatgagattgataaactgcgtctttcagccacttcttctttgagtgaaagaaaagacgtcattattgtttcgagtgtttcctgtatttatggaatcggaagtccaaaggattatcagaatatgattatttctctgcgtccgggaatggaaaaagaccgggatgaggttgctcgggaattgattgatattcagtatgatcgcaatgacatggattttcacaggggaacatttcgggtgcggggagatgtgttggaaattttccctgcggattatacggatacagcggtaagagtagaattttttggagatgagattgaccgtattacagaaattaatgtactgaccggagaaataaaatgccagttaaatcatatcgcaattttcccggcttcgcattatgtcgttccgatggagcagataaaaaaggcagccattcatatagaagaagaattagaagaacgggtgacatattttaaaagtgaggacaaattattagaggcgcagagaatttcagagcgtacaaattttgatatggaaatgttgaaagaaaccggtttttgttcgggaattgaaaattattccagacatttatccggcttagagccgggacaagcaccgtatacgctcatggattactttggagatgactatttaattatcgtagatgagtctcataaaacggttccacagattcggggaatgtatgccggagaccgttccagaaagacaacactggtggattatggatttcgtctgccatcggcactggataatcgtccgcttaattttgaagaatttgaaagtaaaattgaccagattttatttgtatctgctacaccgggggagtacgaggaacaacatgaactcttaagggcagaacagataatacgtccgacaggacttttagatccgatggtggaagtacgtccggtagagggacagattgatgatttggtttctgaagtgaataaagaagtcgagaaaggaaataagatactgattaccacactgacgaaacgtatggctgaggaattgacggattatatgaaagatttgggaatccgtgtgaaatacttacattctgatattgatacgttagagcggacacagattatccgtgatatgcgtttaaatgtatttgatgttttggttggaatcaaccttttaagagagggactggatattccggaaattacattagttgcaattctggatgcagacaaagagggattcctgcgttccgagacctcactgattcagacaattggtcgtgcggcaagaaatgtagagggacatgtcattatgtatgcagatgtgatgacggattccatgaagatggcaatcgatgagacgatgcgtcgccgtagtgtacaggaggaatataataaagaacatcatatcacaccgcagactgttaaaaaagcggtgcgagatttaatcagtatttccaaatcggttgccgagacagaagaaaaattagagaaagaccctgagtctatgagcagaaaagaattagaaaaattaattaaagaagtcgagaagaagatgcgaaaagcagcggcggatttgaatttcgaggcagcagcagggcttcgtgacaaaatggtggaactgaagaaaaatctggaagaaatggattgatttccgctcgaagtcaagtggatattcgcaatccgctacactgcttgctcataaccaaatagctgctacgcagcttatcagaaggggcttgcccctcctgatacaagcaagtccccacccctgcttattgcttttcgcaattgaagtaggggacttacttgatttggttaaaaaaataaaaaaaatttcgtaaagctcttgacaaataaatgggtcagtgctatcttaagagcatagatgttagcactccactacgacgagtgctaacaattaaaaaagaagcagaaaggagattaaaatggaaagtgaattggatgagcgaaaacgaaaaattttaaaagccataatccagacctaccttgataccggagaaccggttggttcaagaacgatatcaaaatacacagacctgaatctcagttctgcaaccatccgaaatgaaatgtcagacctggaagaactgggttacattcttcagccgcatacatcggccggaagaattccttctgataaaggatatcggttatatgtcgatgaactgatgaaggaaaaagaaaaagaagtttcggaaattaaagatttgatgatagaaaagaccgataaaatggaaaaagtattacagcaggtagcaaaagtacttgcaataaatacaaattatgccacaatgatttccggtccgacctatcacagaaacaaacttaaattcattcagctctctaaagtgggtgacaatcaactgcttgcggttttagtaaccgacagcaatctggtaaagaatcagatgattgatttacaggagcctatgagtgatgaaacagttttaaaattaaatctgcttttaaatacgcagttaaatggtcttacaatcgaagaaatcaatctgagcatgataacccggatgaaagaacaagccggtatccacagtgaagtggttggcagtgtgattgatgcggtagctcaggcgattgcagaagacaaagatgaggttgaaatctatacaagcggtgcgacaaacattttcaagtacccggaactggcagatacctcaaaagccagtgaattgatttcagcatttgaagaaaaacatgcgcttgcagatttagtaaaagattcgatgagttcagaagaaaacacaggaattcaggtttatattggaaatgaaagtccggtacaaaccatgagagactgcagtgtagtgactgcgacttacgacttgggtgagggcatgcagggaacaatcggaatcatcggaccgaagagaatggattatgaaaatgtagtagataatctgaaaacgctgaaaacacaattagaccatatatttaagaaaacatagaaaggcggaatggattcgtgtcagaagaaaaagaattatatgatgataaaaacgatgatgtaacagccgagacagaaacagaagaaaccgaagaagttacagaagaaagctgtgaagcagaagaaaattctgaagaagcagaaacagaagaaaaatctgaagaaaagaaaggatttttcaaaaagaaaaaagataaaaaagatgaaaaaatcgaagagctgactgaccgtgtaaaacgtcagatggcagaatttgataatttcagaaaacgtaccgagaaagaaaaagcttccatgtatgaaatcggtgcaagagaaatcattgaaaagattcttccggttgtagataactttgaaagaggtcttgcagcagttccggaagaagaaaaagacagtccgtttgcagacggaatgacaaagatttacaaacagatgatgactgtatttgaagaaatgggtgtcaaagccattgatgcagtcggagaagaatttaatccggattaccacaacgcagtaatgcatgtggaagatgaagaagccggagagaatgtagtagtagaagagttccagaaaggatatctctataaagaccatgtcgtaagacacagcatggtaaaagtagcaaattaatcaattatatctgatttttaaaatcagatttcatcttataaattgatagaaaacttggaattgatataggaggaaaaaatcatgagcaagattattggtattgacttaggtacaacaaatagctgtgtaggtgttatggaaggtggacagccaactgttatcgcaaatgcggaaggcgcaagaacaacaccatctgttgtggcatttacaaaaacaggtgaaagattagtcggtgagccggcaaaacgtcaggcagttacaaatgctgacaaaacaatctcttctatcaagagacacatgggtacagattacagagtaacaattgatgataagaaatattctccacaggaaatttccgcaatgattcttcaaaaactgaaaggtgatgcagaaaactaccttggtgaaaaagtaacagaagctgttatcacagttccggcgtatttcaatgacgcacagcgtcaggcaacaaaagatgccggtaaaatcgcaggtcttgatgtaaaacgtatcatcaacgagcctacagcagcagcacttgcttacggtctggataacgaaaaagaacagaaaatcatggtatacgacttaggtggtggtacatttgatgtttccgttattgaaatcggtgacggtgttatcgaagtattatctacagctggtgataaccgccttggtggtgatgactttgaccagaaggttgcagattacatgatttctgaatttaagaaagcagaaggtgtagacctttccgcagataaaatggcaatgcagagaatcaaagaagcagcagaaaaagcgaaaaaagaactttcttctgcaacaacaacaaatatcaacctgccattcatcagcatgaatgcaaatggacctctgcacttcgatatgaacctgacaagagcaaaatttgatgaattaacacatgaccttgtagaaagaacagcagaaccggttcgccgtgcattatctgatgcaggaatcaatgcttctgaattgggtcaggtactgttagttggtggttctacacgtatcccggctgtacaggataaagtaaaagccttaacaggaaaagaaccaagcaagagcttaaacccggatgaatgtgttgcacttggtgcatctgtgcagggtggtaaacttgccggagatgcaggcgcaggtgatatccttcttctggatgttactccactgtcactgtctatcgagacaatgggtggtatcgctacaagactgattgagagaaatacaaccattcctacaaagaagagccagattttctctacagcagcagataaccagacagcagtagatatcaacgtagttcagggtgaaagacagttcgcaagagataacaaatcccttggtcagttccgtctggatggaatcccgccagcaagaagaggtgttccgcagattgaagttacattcgatatcgatgcaaacggtattgtaaatgtttccgcaaaagaccttggaacaggaaaagaacagcacatcacaattacagctggttcaaatatgtctgatgatgaaatcgataaagcagtcagagaagccgctgagttcgaagctcaggataaaaaacgtaaagaagcagttgatacaaagaatgatgcagacgctatggtattccagacagaaaaagcaatggaagaagctggcgataaattagatgcaaatgataaaacagcagtagaagctgacttaaatgcattaaaagaaatcctgaatggctgtgcaaacaccgatgagattacagatgcccagattgctgacatcaaagcaggtaaagaaaaactgatgcagagtgcacagaaactctttgctaaaatgtacgaaggtgcacagggagcagcaggtgctcaggcaggtccgggaccagaggcaggtgcaggcgcaggagcaaatgaagcttatggcgatgatgtagttgacggagattacagagaagtataaaattgtcagtaaataaaagatatggggcatggggtgctgacaggcgctccatgcctaaatgtgtgtatagaaaggattaaaaccaatggcggataagagagattattatgaggtgcttggtgtcgacagaggcgcagatgattctaccataaaaagtgcatatcgtaagctggcaaaaaaatatcatccagacgtaaacccaggtgataaagaagcagagaaaaaatttaaagaagcttccgaagcttatgcagtattaagtgatgcagaaaagagaaagcagtatgaccagtttggacatgccgcatttgaaaatggcggtggcggagccggcggatatggtggcttcagcggatttgacggcgcagatatgggtgacatttttggagatatttttggagatttattcggcggcggtggtcgtagaagagcgaataatggtccaatgaagggcgcaaatgtcagagccggagttcgtgttacatttgaagaggcagtctttggatgtgaaaaagaactggatttaaatttaaaagaaacctgtgaaacctgtcatggaacaggtgcaagacctggaacacagccggagacctgtccaaaatgtcatggagaaggtcaggttgtctatacacagcagtctatgttcggaatggttcggaatgttcagacttgtccggattgtcagggaaccggtaaaatcgttaaagataaatgtaccgattgtcatggtacaggatatgtgtccaaacataagaagattcaggtaagtattccggcaggtattgacaatggacagagtatccgtatccgtgataaaggtgaaccgggaacaaacggaggaccaagaggagatttgcttgtagaagttatggtagctcgtcatccgattttccagagacaggatatgaatatcttttctactgcaccaattacttatgcacaggcagcactcggtggagaagtccgcatcagtacggtagacggagacgttatgtacgatgtcaaacccggaacgcagactgataccaaagtccgcttaaaaggaaaaggtgtaccgtcccttagaaataaaaacgtacgtggtgaccattatgttacactggttgttcaggtaccaactaagttaaatgaagaggcaaaagaagcacttcgtaaattcgatgccgcctgcggaaatcgtccaaaagaagaaaaagaagaaactccggaaaagaagaaaaaaggcggatgggaaaaattcaaagaaaccattaaagaaacatttgaagattagtaaaaagagaagaaaatttgtgattgtttcacattttttcttctctttttttcgttgcaatctaaaaaaatttcccttataataggaatgttaaatagataaagtgggagagtttatgagaaaatgggcagcatagtggttctaaagcagatggtgatgatatttgcgctgattatacttggatatttcatgtataaaaggaagtttgtatcagaaatggtgatgaaggatttatcagcaattgttgtaaacatctgctgccccgcaatgattcttgcaagtgtgtttcaggatatgtcagatatttccagaaaaaatgtagggattgtaacgggaattggtattgtgtattatgttctgttgattgtgtttggttatgcatttgtaaagatttttcgggtacagacgaaggaaaaagaagcatatgttttgatgagcacgtttggaaatgttggatttatcggatttccggtatcactcgcaattcttggacataaatcaattttgtatgtggtgatttttaattttctgtataatatttttatctttacatttgggattgcattggtaagaaagggaacagaaggcgataaaaaacagtcctggacagatatttttacacccggttttgtctgttgcatttttgcatttttgatttactggtttcagcttaccgttccggagacgcttcagaatatcgtaacttactgtggaaatgcctgtacgtttctttctatgatggtaatcggagcatctgtagtggggttaaatccgaaaaaaataattgaaaatcgaaagcttatgctatttgaattattgcggtttctggtcttaccggttttaattgcaattttgttaaaaccaattcttccggattatattatgcgtgcaaccattattttaatgttggctcttccaaccggaaatatgccggttatgttagcggaacagtataataaagatgcacatacaatatcagagggaattattttgtcgactgtattatcggtagtgacaataacgattgtatttatgtttgtataagagagtatagataaagtatagataaagaaaggaaagactaactatgaagtggaataaaattactttggaaatcagagaagaagtagaagatattgtcatttccacccttgcagacatcgggcttgaaggtgcggaaattcaggacaaacagccgttatccgaacaggataaaaagcagatgtttgtagatattcttccggatatgccggaagatgatggggttgcatatctgaatttttatctggatgaggatgaagatgtcaatgcaatgcttgaaaaagtaaaggcagaattagaagagttaagaatgtttgtagacatcggttccggaatgattacactttcccagaccgaagacaaagactggattaacaactggaaacagtatttcaagcagttttatgtagatgatatcttgattattccatcctgggaagaagtaaaagaagaagataaagaccgaatgattatccatattgacccaggtacagcgtttggaacaggtatgcatgagaccacacagctttgtatccgtcagttaaagaaatatgtgacaagcgagacagaactgcttgatgtcggaacaggaagcggaattttatcgattgtagcattgaaattaggagcaaaacatgcagtcggaacagaccttgatccttgtgcagttccggcagtagaagaaaataaagaggcaaatgagattccggtagaagcttttgacatgatgattggaaatatcattgatgataaagaagtacaggataaagttggctatgaaaaatatgatatcgtagttgctaatattttagcagatgtattagttccactgactccggttatcttaaatcagatgaaaaaaggtggaatttatattacatccggtatcattgacgacaaagaagaaactgttgtaaatgcggtaaaagcagccggtcttgaagtgttagaggttacacatcagggagaatgggtgtctgttacggccagaaaaaattaaggagcaaaaaatgtatcgtttttttgtagaaccgtctcaggtagaagaaacggtcattcgcatctgtggcagtgatgtcaatcatatcaaaaatgtactgcggatgaaaaccggagaggaaatcctgattagtaccggagagacaatggaatatacgtgctacatcgaagaatttttagaagatgaagttactgcgcatatcatgtatgcacaggaagcaggatatgaactttcttctaaaatctatctgtttcagggacttccaaagtcagacaaaatggaatggattattcaaaaggcagtagagctgggtgtgcatcaggtgataccggtggcaactaagcgagcagttgtgcgtctggagggaaaaaaagaggtaaacaagcagcgtagatggcaggcaatttcggaaagtgcggcaaagcagtccaaacgtatgtatgtgccggaagtcagtcatgtgatgagttttaaagaagcccttgcttatgcaaaaaatctggatgtgattcttttaccttatgagcgtgcaaaagggatgcaggagacaaaagcaatcataaacagtataaaaccaggtcagtcgattggaattttcataggaccggaaggtggtttcgatgaaaaagaagtcgaacagtcaatggatgagggtgcaaaagcaatcactcttggaaaacgaattttacgaacagaaacagcgggattgacagtgctttcagttctgatgtttgctttggaggaataaaataaaatggaagcatatcttgataattcagcaaccacacagtgctttgaagaggtaagagacattgtagtaaaaactatgatggaagattatggaaatccgtctgcaatgcacaaaaaaggcgtggaagcagaacagtatgtaaaagatgcgacagaaaaaattgcaaaaactttaaaagttcaggaaaaagaaatttattttacatcaggcggaacagaatccgataactgggcacttgttggatgcgcttatgcaaatcgcagacagggaaaacacattatttctaccgtgtttgaacatgcagcagtttcagcaccgcttgcagcattagaggaacagggatttgaaataacaaaaattccggttgatgcaaacggaattctttcgatggaaaaactggaatctgcaatccgtccggatacaattttagtttctacgatgtatgtcaataatgaggtaggagcagttgttccggtggaagagattggaaagctggttcatgaaaagaatccgaaaacaatttatcatgtagatgcaattcagggttatggaaaattccgtatctatccaaaacggatgggaattgatttgttatctgtaagcagtcataaaattcatggaccaaaaggagttggatttttatatgtaaatgaaaaaataaaaattcagccgatgattcttggcggtggacagcaaaaaggcatgcgttccggtacagataatgttccgggaattgcagggcttggagtggcagcgaagaagatttatgaagatttcgatgaaaaaattgaacagttaaaggaaaataaactgtatcttgcaaagagacttcaggaactggacaatgtctttatcaatggtccaaaaccagaagatggggcaccgcatattttaaatgcaagctttgtcggagtcagaagtgaggttctgcttcataccttagaagaaaaacagatttatatttcagcgggaagtgcctgctccagccacaaaagagccgcaagtgcaaccatgcttgcacttggagtctcagcagaacgcagagagtccgcaattcgtttcagtctaagcgagatgacaacaaaagaggaacttgattatgcggtagatgaaatcgcaaaagtacttccggtgcttcggaaatttgcacgacattaagatgtaaaagaagttaatgagataaaaaagaataaaagacaatattatgaaatgaaaggaaacgatatgttcaaagcatttttgataaaatatgcagagattgcaattaaaggaaaaaacagatatatttttgaagatgcgcttgtagaccagattcgtcatgtattaaaagaagtagatggcgaattttcagtcgtaaaagagcgtggtcgaatttatgtctatgcagacagtgaatttgattatgatgagacaatagaggcattaaaacgtgtctttggtatctttggaatttgtccgactgtagtattagaggacaaaggctatgaagagttatccaaagaagtggttgcttatgtgaaagagatgtacaaggatgagccaaaaaccttcaaaatggacgtgcgtcgtgcaaagaagagctatccgatgacgtctatggaaatgaacgcacagcttggcggggatgtactggattcctgtccgaatatgaaagtggatgtgcatgaaccggatgtgatgattcatgtggaagtcagagataagatttatctgtattctgaagtaattccgggaccgggaggtatgccggttggaacaaatggaaaagcgatgctgttattatccggcggaatcgacagtccggttgccggatacatgattgcaaaacgtggtgttaagattgatgctgtatacttccatgctccgccatacacaagtgaaagggcaaaacagaaagtcgtagatttggcaaaattagtagcaaaatacagtggaccgattcatcttcatgttgtaaattttacagatattcagctgtatatttacgaaaaatgcccgcatgaagaattaaccattatcatgcgtcgttatatgatgaaaattgcagaagaatttgcaaaaaaagacggttgtctcggattgattacaggagaaagtatcggtcaggtggcaagccagacaatgcacagccttgctgctacaaatgaagtctgcaccatgccggtattccgtccggtgattggatttgacaaacaggaaattgtagatgtggcattaaaaatcaatacttatgagacctcgattttaccgtttgaagactgctgtacaatctttgttgcgaaacatccggttacaaaaccaaatctgaaagtaattaaacgctcagaagagaagttacaggataagattgaagaaatgatgatacaggctgtagagacagcagagacgattgtgtgtgagtaaaatttgcaataataaaataataagagtcatacagaattgtgtggctcttaagatttctttattaatgagtgaaaagcagaaatagaaaaaaggactgttaaaacagtccttggtttctatcatccattttatattagtctactaaatatggttttaagacagtaagaatatcgtctaaagcaccatcagttgcatggatgtttaaatcaatagatttggataaatctaagctgaagatacccatgatagattttgcatcgattacgtatcttcctgatactaaatcaaagtcatagtcaaattttgtgatttcatttacaaatgatttcactttgtcgatagaattcagagaaattttaactgttttcattggacaaatcctcccttacaatcagtgttttttgctttttacaagcataatgttaccgttaatggggcaaaaagtcaatatctaaaagagagaaataaaatacaaataattcggaaactattcgtcaaaacgcttaagaataaataggagtaaaatagaaatatatggaaaagaaagttgcattgcacaatttaggatgtaaagtaaatgcttatgagcttgaagcaatggaacaaatgcttaaaaatgcggggtatgaaattgtaccatttgcgcctggagcagatatttatatcattaatacctgtacggttacaaacattgcagaccgcaaatcaagacagatgcttcataaggcaaagaaaatgaatcctcaggcagttgttgtggcagcaggctgttatgcgcaggcgcaaaaaggagaagaaattgacgaggcaattgatattgtgcttggaaataacagaaagcaggatttgattgccgtgctggaagagtatcaaagcggaaatggtcagaaggaagagagaatagaccttgaaaaaccggtagaatatgaagaactggagctggcttccacaggagagcacaccagagcttatttaaaagtacaggacggatgcaatcagttctgcagttactgtattattccttatgtcagaggtcgtgtcagaagccgtaagagagaggaagtcataaaagaagtagaacgtctggtagcacttggatatcaggaatttgtcttaaccggaatccatttaagttcttatgggattgactgtgaggatagtctgttaaatctgattgtggcagtacagaatgttgagggtgtaaaaagaattcgtctgggttctttagaaccgcgtattattacagaagagtttgtaaagaccttaagcagtctgccggctatctgtccgcattttcatttgtctttgcagagtggatgcacggaaactttaaaacgaatgaaccgtaaatataccgcaggagaatacttagaaggatgtcgtctgcttcggaaatattttgaccatccggcactgacaaccgatgtaattgtaggatttccgggggaaacagaggaagaatttaaatcctctaaggaaatggtgtcagaagctaaattctatgagactcatatttttaaatattcaagaagaaaaggcacaagagcagataaaatggaaaatcagattccggaacaggtaaaagcaagcagaagtcatgagatgattgagcttggaaaagcacatcagaaagaatatatggaatattatcttggaaaacaggttgagattttatttgaggaaacaaccgagattaatggacagacttactgggtcggtcatacaagagagtatataaaagttgctgttttatcagaaaaaaatctggagaatcagcttgtaacaggagaaattaccgaatttcttcaggatgggatttttaactgccgaatataatggttgaatttcctagaaagatatattaaaatagtggtaaagttttagataagggcgtgataatatgggaaatttagatagtacacaatattttaatgtaaaaggcgatccggaaatcagagtaaaagatgttttggatttggtatacaatgcgatggcagaaaaaggatataatccggtgaatcagattgtcggatatattatgtcaggagacccgacttatattacgagctacaagggagcaagaagtacaattatgaaagtggagcgcgatgaacttgtagaggaacttttaaaagaatacattaaaaatgagtcctggaagcacgagtaagattatgagagtgatgggactggattatggctctaagactatcggggtggcaatcagcgaccctttaggtcttacagcgcagggaattgaaattattcgtcgggaagaagaaaataagttaagaaaatcccttcgccggatagaagaactgattaaggaatatcaggtagaagaaatcgttctgggatttccgaaaaacatgaacaatacaattggagaacgggcggagaaatcgctgcagttaaaggaaacactggaaagaagatgtaaactgccggtaattatgtgggatgagagactgacaactgttgaagcaaaccgtacactgatggaaagtaaagtgcgcagggagaacagaagtaaatatgtggatatgattgctgcagtatttattctgcagggatatctggattcaaaagcaaacccgggtacagtttaatttcggttaaaatgccagaaatggtatttttaagaaaaaaagaaacggctgttatccgggattttagcgtataaaaaaataaattacgataagaaaggatgaggttatggaaacaattatttttgatggagaggacggaagtcagattgaacttggagtcgttgcgcagacaagagtaaatggaagtgtttatttgctgacagtagacccggaagagtccggtgaagaaggcagtgcagcttatattttaaaagatacctcagaagatggagacaaggacggctgttatgtatttgtagaggatgacacagaatttgatgcagtgtataaagtctttgaagtgatgttggatgagattgattttgaatacgaataataaaaggaacggcaaaaattggaggaattaatttgaaaaaaaacaacaactcaaaattgaaaatcattccattgggcggactggaacaaattggaatgaacattacagcctttgaatatgaggatagtattgttgtagtagactgcggactttccttcccggaggacgatatgctgggaattgatttagttattccggatgtcacctacttaaaagaaaatatttccaaagtaaaaggctttgtaattactcatggtcatgaagaccatatcggagcacttccttatgtattaaaagaagtgaatgtgccgatttatgcaacaaaacttaccatcggactgattgagaataaattaaaagaacacaatctgatccgtacaaccaaacggaaagtgattcgtcatggacagtccattaaccttggctgtttcagaatcgaatttattaaaacaaatcacagtattcaggatgcttctgcactggcaatctactcaccggcaggaatcgtcgtgcataccggtgactttaaagtggattacactcctgtatttggggatgcaattgatttacagagatttgcagagattggaaaaaaaggtgtccttgcgttgatgtgcgacagtacgaatgcggagcgaaaaggctttacgatgtcagaacgtactgtaggaagaacatttgacaatatttttgcggagcatagaaatacaagaattattattgcaacatttgcctcaaatgtggatcgtgtacagcagattatcaactcagcctataagtatgggagaaaagttgcggtagagggccgaagcatggtaaatgtcatcggtacagccgcagaacttggttatctgaagattccggataaaacgttaattgatatcgaccagcttaaaaactatccggatgagaaagttgtattgattacgacaggaagtcagggagaatctatggcggcattgtcccgtatggcagcaagtattcataagaaagttacgattaagccaaacgatacgattattttcagttccaatccgattccgggaaatgaaaaagcagtatcaaaggtgattaatgaattaagtatgaaaggtgcagacgttatctttcaggatgcacacgtttccggacatgcatgtcaggaagagattaaactgatttattcccttgtaaaaccgaagtatgccattccggtgcatggagagtacagacacttaaaagcacaggcaggtgtggcagaagaacttggaattccaaaggaaaatatctttattctttcttccggtgatgtgcttgaactaaatgaagaagaaccggcaagagtaaccggacaggttcgtacgggagcaatctttgttgatggtcttggtgttggagatgttggaaatatcgtacttcgtgatcgtcagcatctttctgaagatggtattatgattgttgtgcttactttagaaaaacattcgagcaatcttctcgcaggaccggatatcgtatcacgtggttttgtctatgtgcgtgaatcggaagatttaatggaagaggccagaagtgtagtggaagaggcgattgacagctgtctggagagacatattacagactggggcaagatgaaaaatgtgattaaagattctctgggagaattcttgtggaagagaaccaagagaagtccgatgattttgccgattattatggaggcataattccatgagtaatattgattattatgtaaacagggtgattgaggagattaaaagtgagagtgtttacagacaatacacgacttctcttgaaaagcttaacgcaaatcctgagataaaacggcaggtcgatgaactgcgcagattaaactatcaggcgcaggtaaaaaatgatgatacagactcttatgacaccatagatgacattgatgataagataaatgaattaagctgtataccggaagtgaatcagtttttagaggcagaagctgcactttgcagactcctgcaggatatttcggtaagagtacatgaggcgattcatttagatgtaccggacttgaattaggggaatgcttatcggcattcaattggcaggattagcaggagactttaatattccgagggtgcattaagaaaataaggagaaaaaaatgggaagaggaatcagaaaacagggtgcggcatcaatttttgcaggtggatttttccgctttgctgtgtatgcctgtgtggtgtgtgccgtgatttatgttggaaaatcagcgtatgattttggatatgcgattttcgaccagatacctgtggatgatgaagaccatggagaagatgtaactgttgtaatcaaagacggagcgtcggtgtatcagattggaaagattttaaaaagcaaaggtctgattaaagatgcaaaagtatttgtggtacaggaaagtctttcaaattataaagataaattacagtcgggaacttatattttaaatacttctatgacgacagatgaaatgctggcagtgcttgcaagagaagatatgacaggacagccggagcaggattccacggattctctggacacttcagcggatggcacagatgtgcagacaacagaagagtccgttacagatgagagtcaggatgcgtcaggagaacaggcaggagaaacggctgaataagagggaaaaaaagtgattgttgatgaaagaatggttacctatataaactctctggacaaaggaaatacgccttttttgactcagcttgaaaaggatgcaaaggaaaattatgtgccgattatacggcgggaaatgcagagctttttaaaagtaatgctacagatagcaagtccccatctcatcttagaggtggggactgctgttggtttttccactcttcttatgagtgagtatgcaccgaaagactgcagaatcacgacgatagaaaattatgagaagagaataccgattgccagagaaaattttaaaaaagcaggaaaagaagagcagattaccttattagagggggatgcggccaaaattttaaagacgctggagggaagttatgattttatctttatggacgcagcaaaagcgcagtatattaacttctttccggatgtgctgagacttttgaaaaaaggcggaattttgatttctgataatgtactgcaagatggagatattatcgaatctcactttgcggttgagagaagaaaccggacaatttataagcggatgagggaatacctttatgtgctgaaaaatcatgaagaacttgagacaagtattattcctctcggtgatggagtaacgcttagtattaagaaatagaaaggcaggaaagatgagagcaaaaccagagttattaattccggcaagcagtctggaagttttaaaaatagcggttatttttggtgcagatgcagtttatatcggtggagaagcctttggactgcgtgcaaaggcaagaaacttttctatggaagacatgaaagagggaattgaatttgcacatcagcaccatgtaaaagtatatgtaacagcaaacattttggcacacaacaaagatttggacggagtaagagaatatttccgtgaattaaaagaaatcaggccagatgcactgattatttctgacccgggtgtatttatgattgcaaaagaagtatgtccggagattgaacgtcatatcagtactcaggcaaataataccaattatgaaacttataagttctggtatggactgggcgcaaaacgtgtggtcagtgcaagagaactttctttagaagagattaaacagattcgtgcaaatattccggatgatttggaaatcgaaacttttattcatggtgcaatgtgtatttcttattccggaagatgtctcttaagcaatttctttaccggaagagatgccaatcagggtgcgtgtacgcatccgtgcagatggaaatattcgattgtagaagaaaccagaccgggagaatacatgccggtttatgaaaacgagcgtggaacttatatctttaactcaaaagatttatgtatgattgagcatatggatgatattctgacttcaggaatcgacagcttaaaaattgaaggacgaatgaaaactgccctttatgtggcaacggttgcaagaacctacagaaaagccattgatgattattttgagagtccaaaattataccgggaaaatatggaatggtataaagagcagattatgggctgtacctatcgtctgtttaccaccggatttttttatggaaagccagatgaaacttcccagatttatgacagtaatacttatgcaaaagactacacatatcttggtttcttggaagaaaagacagaaaaaggactctatcgaatcacccagagaaataaattccttgtaggagaaacgatagaggtcatgcgtccggatggagaaaaccgtctggttacggtaaaagcaatctatgatgaagagggaaattcctgtgatagtgctccgcatccacagcaggtgctgtatctggatttgggagaagatttaaatgtctttgaccttttaagaagaaaagaaagcgtttcttaactttaaaatcgcatttttttcaatacgggacacataagagcggctgatattcagccgctttgctatttcccgctgggtcagctcatcacagccataaagcccaaagcgtagttttaagacttccgcttcccgtttggtcagtacgaaaccgagcaggtagtaaagtttacggatatcctgttttaaagaataattttttacgacatcgacaggctcattttcaatcacatcaagcagattgatttcatttccttcacggtctgtaccgattggctcataaagagaaatatctttgctggttttctttttagaacgaagcagcataagcagttcattgtcgatacagcgggcagcataagtggagagccggttggatttttcctgattaaatgtatgaattgcttttatcagaccgattgttccaatcgaaatcaggtcatctaattcttcttcaaccccttgatatttttttacaatatgtgctacaaggcgcagattgcgttcgatgagaacattttttgcttcctgactgccccttttgtattcttggagataatatttttcctcctcggatgtcaagggcttaagaaatgttttcaagcagccttacctcaaagggatttaataatagtctatgagaaaaagggataaattgtgcttttccaaaaaaagaaaaaatgtttgtatcaaaaggaaaattgtgatacgataatcgaatcagaaaacaattcatgttttccggtacagctgcttaatcttcgctgtaccagttctggcagttctgccgttttttcaaattttaaatttatttaatttcaaatctaagacaagtaattatgagtttaggaggcattttatgtatgttcagtaaagtgttgtcagcggctattgatggggcaaggtgcgttccggtatcagtagaagtggatgcaagtaatggacttccggcttttttgatggtaggagatttatcttatcaggtaaaagaagcgcaagagagagtccgtactgcgataagaaacagtggaatgacaattccacccaaaagagtaactgtaaatttagcacctgcggatgtccgtaaagatggaaatcattttgatttgccaatagcggcttcgcttatgattgcatttggctttctggaagcggaaaaattcgatggcgtgatgcttgccggagaacttggcttaaatggcaggattaatggagtcagaggaattctgccttttgtagaaaccgcttacaaaaagggatgtcggctttgtattgtgccaaagcaaaattacagggaagcacggatgattggacagatttctgtgcttggagtggagtctttgcaggaatttttaagctgtgccagaaaagaaaactgggggcttttagaagatacaaaagaagagccggttttattgcctgcaaagaaagaagaaatcgaagattttgctgatattcaaggtcaggaatatgtgaagcgggcagccgtgattgcggcagcagggatgcataactttcttatgaccggtccaaagggaacaggaaagacgatgattgccagaagaatcccagggattctgccagaacctaccaaagaagaactgcttgaagtatcaaagatttacagcatttcaggtctgttatccgaagagaaaccgtttcttttatctcgtccatttcgggcaccccatcacaccatttcaccggcagcacttgccggaggtggaaagtatccaaaagccggagaaatcacgcttgcccataagggcgttcttttcttagatgaatttccggagttttcccatgaatgtattgaattattaagacagccgttagaagaacggaaaattttaatcagccgaagcggaggttcgtacttgtttccggccgattttatgctggttgctgcaatgaaccactgtccctgtggtcagtttccggatttaaatcggtgcagttgtacgtttcaggaagtaaagcgttatcagaatcgaatcagtggtccgattttagacagaattgatattgtggcagaagtgtcgggaatttcttatcaggaactgaccggaaaacggaaagaaaaaagttcaaaaaaatttagaaaagaagttgagatggcagtaaaggtacaaggggaacgctatcaggagaaaaagattcggtttaattctcagctttccggtaaattattggaggagttttgcaatgtaagtgcagagggacagcgaattttggaaaaagcgtataaaaaaatgagattaagtgcaagggcatatcataaaatcttaaaaacggcacgtaccattgcggatttggaacaagaagaggagataaaagaagcgcatatcagtgaagcactttgttatcgaagagtagaaggaaaggatacttgaaatatggaagaaaaaattgtaagttatacaccggatgacgttgagtatccggataaattaagaaattttaaagacagacccaaacggttgtatgtaaaaggaaaacttccggatccaaatcgcaaaagtgtggcgattatcggggcaagaatgtgcagttattacggcagaacgcaggcttatgaatttgcaaaagaatttgcttcttgtggagttcaggttatcagcggactggcaagaggaattgatggctgggcacataaaggtgcaattgatggcggaggagaaacatttgcggtgcttggttgtggagtggatatttgttatccgagccagaatatcaatctctatcgtgagattcagaaaaagggaggaattatctctgagtatgaggaaggagagaaaccccttggatggcattttccgttaagaaatcgaattatcagtgggcttgctgatattgttttagtaatcgaggcaaagaaaaaaagcggttcattaattacagtagagtatgcacttgagcagggaaagtctgtctatgcgcttccgggaagagtgggggaagcattaagtgaaggatgcaacaatttaatttttcagggagcacaaattgcaaaaaatgtggaaattatcctcgaagaactcgaaattttggataaaatgacgaaagaaaagaataaaaaaacagagataaggcttgcaagaaaagaagaaatggtgtatagttgtgtggatttgaaaccaaaacacctggacgaaattataaaattgactgacttggaattgcttgaagtgcaggaaattttggtgaaattagagttgatggaacttgtaacagagccaataaagaattattatgccagagcgggaggttgatatggcaaagtatttagtgatagtggaatcgccggcaaaagtaaagacaataaaaaaatttttaggttccaattatgaagtcatggcatcaaacggacatgtaagagatttgccgaaaagccagttggggtttagtgtagaaaatgattatgaaccaaagtatataacaattcgcggaaagggtgacattttagcagcacttcgaaaagctgcgaaaaaagcagataaagtttatcttgcgactgaccctgaccgtgagggagaagcgatttcatggcatctttcaaaggcattgaagttagatgataaaaaaatgcgtcgtattacctttaatgaaattacaaaaacagcagtcaaagcttctattaaagaggctagagagattgatttaaaattagtggatgcacagcagaccagaagaatgttagaccgtatggttggatatagaatcagtccggttttatgggcgaaagtaaaacgtggattgagtgcaggacgtgtgcagtctgttgctcttcgtattattggagacagagaagaagaaatcaatgcatttataccggaggaatattggactttagaggcacagtttgcggtaaaaggtgagaaaaaaccgctgactgcaaaattttatggaaaaaaaggacagaaaatcaatattcattccaaaggagaactcgatgaaattttaaaaaaccttgagggtgcaagctatgaggtggatgaagtaaaaaagggagagcgtaccaaaaaagcaccatttccatttactaccagtaccttacagcaggaagcctccaaagtgttaaacttctcgacacagaaaaccatgcgtcttgcacagcagttatatgaaggaattgatatcaagggaaatggaacagtcggtgtgattacttatctgcgtacggattcaacccgtatctcggatgaagcccagaaagcagcacaagagtatattacagaacagtatggagaagaatataccaaagtaactgagaaaaaagatagtaataagaagaaaattcaggatgcgcatgaagcaattcgtccaaccgatattacaagaaccccgatttctttaaaagagtctttaaccagagaccagttccgtctgtatcagttaatttggaaacgttttaccgcaagtcagatgcagcctgcaaaatatgaaaccacttccgttaaaattaaaggcggagagtattattttacaacatctgcatcgaaattaaaatttgatggtttcatggcagtttatgtgcaggaagatgatgaaaaatcagataagacggttttgacaaaagggctcgatgagacgagcgagttgacatttgagaaatttaacgaacagcagcattttactcagccaccggctcattatacagaggcgactcttgtaaaaacattagaagaacttggaattggacgtccaagtacctacgcaccaaccattactacgattattgcaagacggtatgttgcaaaggaaaataaaaacctttatatgacagaaattggtgaagtagtcaataatattatgaaaacttctttcccaagtattgtagatgtacattttacggcaacaatggaagaactgctcgatagtattgcagaaggattgattgagtggaaaacggtaattcgcaatttctatccggatttggatgaggcagtaaagacagcagaaaaggaacttgaagaagttaagatagaagatgaggtaaccgacgtaatctgtgaacagtgcggaagaaatatggtaatcaaatacggaccgcatggaaaatttctggcttgccctggatttccggaatgtcgtaataccaaaccatatctggaaaaaatcggagtaccgtgtccaatctgtggaaaagaagtagtaatgcgcagaagtaaaaaaggacgccgttattatggctgtgaaaacaatccggaatgtgaatttatgtcctggcagaagccatccaaagaaaaatgtccaaactgcggtggatatatggtagaaaaaggaaacaaactggtctgtgcaaatgaacagtgtggatttgtaaaaatacagccgaaagacaaaggcgaagaggcttaaataaaaatccaagtaaagtggacatttgtggaataaaaacaatgaaaataaatggttaatttagggcgattgcaggaaaagtcttgtagtcgctctttttggtgaaagaaacgaaattgttagaaaaaaatgaatagacagaaaatagctatattatccattgatttcagaataattgtgtggtaaaatgaaaaaaggaaaaataaatgtaatatataggattggatgctgaacaaaacgaaaggagatttattatgagcgtacaattactagacaagaccagaaaaattaataaactgctccataataatcattcttccaaggtattatttaatgatatctgcgaggtgatggtagagactctggactccaatatacttgttatcagtaaaaaggggaaagtacttggtgtcggaacatgtcagggagtgcaggagattacagagctaattgacgatgaggtcggcggatttattgataagctcttaaatgaaagactgcttggagttttgtcaacaaaagaaaatgtcaatttacagactcttggatttgaaagcgaaggtattgataagtatatggctattatcagtccgattgatattgcaggagaacgtttaggaacactctttatgtaccgtgataccaaaagttatgatatagaagatattatcgtaagtgagtacggaacaactgtggttggtcttgaaatgatgcgttccgttcatgaagaaaatgcagaagaaaatcggaagattcaggtggtaaaagcggctttcaatacactgtcattctcagagttggaggcaatcattcatatctttgatgaactcgacggagatgaggggatcttagttgcaagtaagattgcagaccgtgtgggaattacaaggtctgtgattgtaaatgcacttcgtaagtttgaaagtgcaggagttatcgaatctcgttcttccggtatgaaaggaacctatattaaagttttgaatgaagtgatttttgatgaactcgatgaaattaaaaaaagaaaaatcgtgaagaataataaatagaaataataaatagaatagaaatgaatgaatcaagaatagaaagtgaagagacttcatatagtaagagggaacttgactttctatttttttatttacagaaaattactttcctgtaaataaaaaaacgctccgcggggatgcgcactgcggcgtacaaagtagatgtcacaagcgaccaccgcaggcgcgagaatgtgccttgccacattctctattttgaatttataaaaattgtatgaaacatgtacaaaaataaaaaaataagaaaacataagaaaaaatgagaaaacataagaaaatatcatgaaatataaaatattacacattttgttgcagttgcggaaataagctgaattaactaatatatgactaacggttagcactcgattaaaatgagtgctagtaaaatgagattgataattctaaaggaggcattttagatatgaaattagtaccattaggagacagagttgtattaaaacagttagttgcagaagaaactacaaaatccggtatcgtattaccgggtcaggcacaggaaaaaccacaacaggcagaagtaatcgctgtaggtcctggcggagtagttgatggaaaagaagtgaaaatggaagttgccgttggagatcaggttatctattccaaatatgccggtacagaagtgaaattagacggggaagaatacattatcgtaagacagaacgacattcttgccgtagtaaaataaataagaaattataattcttaaaaatcgtaattctcaaaaatcaggaggaaaaaagtaatggcaaaagaaattaaatatggagcagaagcaagagcagctcttgaaaatggtgtaaataaattagcagataccgtacgtgtgacattaggaccgaaaggaagaaacgttgtattagacaaatctttcggtgctccgcttattacaaatgatggtgttacaatcgcaaaagaaatcgaattagaagacggttttgaaaacatgggtgcacagctcattaaagaagttgctgctaagacaaatgatgtagccggtgatggtactacaaccgcaactgtactggctcaggcaatggttcatgaaggaatgaaaaacctggcagcaggtgccaacccgattatcttaagaaaaggtatgaaaaaagcaactgcaaaagctgtagaagcaattcaggcaatgagcggaacaattgaaagcaaagatcagattgcaagggttgcagcaatttctgccggtgatgacgaagttggtgaaatggtagcagatgctatggaaaaagtaagcaatgacggtgttatcacaatcgaagaatccaaaacaatgaaaacagaactggatttagtagaaggtatgcagtttgacagaggatatatttctgcatatatggcaacagatatggacaaaatggaagctgtattagatgatccatatattttgattacagataagaaaatttctaatatccaggatttacttccggtattagagcagattgtaaaatccggtgcaaaactgttaatcatcgcagaagatatcgaaggagaagcgctgactactcttatcgtaaacaaattaagaggaacattctctgtagtagctgtaaaagctcctggatatggcgacagaagaaaagaaatgcttcgtgatatcgcaatcctgacaaatggtacagttgtatctgacgaactgggtattgaattaaaagacgtaacgatggatcagcttggacgtgcaaaatctgttaaagtacagaaagaaacaacagttatcgttgatggtgaaggttctaaagaagatatcgaagcaagaatcgctcagattaaacatcagattgctgaaacaacatctgaatttgataaagaaaaattacaggaaagacttgcaaaactttccggtggagttgctgttatccgtgtaggtgctgcaacagaaacagaaatgaaagaagcaaaacttcgtatggaagatgctttaaatgcaacaagagcagctgtagaagaaggtattatcgcaggtggcggttctgcttatatccatgcatcgaaagaagttgcaaaactggttgaagaacttgacggcgatgaaaaaacaggtgcaagagtggtattgaaagctctggaagctcctctgttccatatttctgcaaacgcaggtctggaaggctctgttatcatcaataaagtaagagaatctgaagttggtgttggatttgatgcattccatgaagagtatgtaaatatggtagaaaaaggaatccttgacccgactaaagttacaagaagtgcattacagaacgcaacaagtgttgctggaactctgttaacaacagaagcagttgtttctacaatcaaagaagagactcctgcaatgccagcaggtaatccgggaatgggtatgatgtaatttaaccaaagcggattgcgaatatccgattgacattttaagaaattcttatgccggtgtcagctagacaccggcatttctttatgatagactaaaagagataagaaaaaatgcatgaaaatgcacgaaaaaacgaaaggagaacgaagtgaacgacacatattcagaacttctgataaaaaaagaagtaactgcaaaagacaagatgataaaagtgcttctgattgcactgattgcacttatggcagttgccggaattttaattacaccgcttgcatttattgcagcgattgcgcttggaattgcagcctattttgtgtttccgaatctggatttggaatttgagtatgtctatgtaaatggagaactcgatattgacaaaattatggcgaagatgaagagaaaaagagccaaaagttttgaactttccaaaatggaaattatggcgccggtaaaatcccatagactggattatcagaaccagaataccagaatgaaagtttatgatttttcatcaggaaatccatcacataaagtttttgcgatgattattcctagtgacaatgaactctgtaaagtgttgcttgagccggacgaagaacttttaaaaaatattgaaaaaagttgtccgagaaaagtttttgtggattgacacttttgtcggaatttgttatattttattactataaacaaaatgaagggagaaagacaatgggtaagattattggtgaaggcattacctttgacgatgtactcttagtaccggcttattctgaggtgattccaaatcaggttgatttaacaacttatctgacaaaaaaagtaaaactgaacattccgatgatgagtgcaggaatggatacggttacagaacatcgtatggcaattgctatggcaagacagggtggaattggtattatccacaaaaatatgtcaattgaagcacaggcagacgaagtagataaagtaaaacgttctgaaaatggtgttatcaccgacccgttttatttatctccagaacatacactggaagatgcaaataatcttatggcaaaattccgtatttcaggtgtgccaatcacggaaaacggaaaattagttggtattattacaaaccgagatttgaaatttgaagaagatttcagcagaaaaatcaaggaatgtatgacatccgaaaatcttgtaacagcaagggagggtgttacactggaagatgcaaagaaaatccttgcaaaatccagaaaagagaaacttccaattgtcgatgagaatttcaatttaaaaggtcttattaccattaaagatatcgaaaaacagattaagtatcccttatctgcgaaagatgcacagggcagactgctgtgtggtgcagcagtaggtatcacagcaaacgttatggctcgtgtggatgcacttgtaaaagcaaatgttgacgttgttgtcgtagactctgctcatggacattctgcaaatattttaaaagcagtccgcgaaatgaaagaaaaatatccggatttacaggtaattgccggtaacgttgcaaccggtgcagcaacaaaggctttaattgaagctggtgttgacgctgttaaagttggtatcggtcctggttctatctgtacaactcgtgtcgttgcaggtatcggtgttccgcagattactgcagttatggactgttacgaagcagcaaaagaatatggtatcccgattattgcagacggtggtatcaaatactcaggcgatatgacaaaagcaatcgcagccggagcaaacgtatgtatgatgggaagtatgtttgccggatgtgatgaaagccctggagattttgaattatatcagggaagaaaatataaagtatatcgtggaatgggctctattgcagcaatggaaaacggaagtaaagaccgttatttccaggaaaatgcaaagaaattagttccggaaggtgttgaaggacgtgttgcatacaaaggacatgttgaagatacagtattccagttaatcggtggacttcgttccggtatgggatattgtggagcaaaagatattgaaacattaaaagcaacaggacgttttgttaagattactgctgcgtctttgaaagaatcacatccacatgacattcatatcacaaaagaagctccgaactacagcgtagatgacaaataatacaaaagagtttcagatgtaaacataaacggcaggagctgttgtctttgggcaatggtttctgccgtttttggcattggggagagttttttatgaaacgaaagaaaaaaagaatcagaacaagatggaatataaaggtattcgttatttatgcagtgactttatttttcattatttttggggtaaaaactgcggttgttaagattgcagaattgatacagggcagagtagaagcacagtctcaggaagagacagatgtaacggcagaagaagaaacggaaaaaaacgcagactttccgggagcgccaccgtttacagttgatttgctcgatatcaatgaatattcaagacccgggattgcacttgaaaaaatcaatggaattgtaattcattatacggcaaatccaaagagtactgcaaaacagaacagggattattttgaagggttaaaagacagccatgagacaaaggcaagcagtcattttgtagtgggaataaaaggagaaattgttcagtgtattccaagttcagagatttcgtatgcttctaattcgagaaacagtgataccctttcaattgaatgttgtcataaagataagagtggaaaatttacaaaagagacctatcagtctttagttgaattagttggatggctttgtcagagatttggacttaccagtgagcaggtgattcgtcattatgatgtgacaggaaagaactgcccgaaatattttgtagaacatgaagatgagtgggaacagtttaagaaagatgtagatgttcagattgcagttgtggaacaggaagtagaaactgccagtcaacagtaaatttggatttgaaaggaaagatttaagatgaaaaagaaaaaaattttacagcgggcagttacctattatcgttctcacatgtggtgttctcttttggtttcgatttttggcatgatttttatcattgctctgattttattgggatatatgaagagcaaatattatcagtatctgctcgatacgacttatgaatcagagaaagtgatgatagagtccgttaagaaaaatattgaaaatcagatggagtcctttattgatttgggggcaaatattgcagtggaggaccggcttgtacaggaaattgaagactatgtacaggcaggaaagaccaatcagtatgcttctaagctgatgcggacaactttaaaaagtacaacttatggaagcggttccattaccggagttgcagtaattgaagaagatggtctgcttgcgcagttttccagagaagaagtgggcacagaaaaagtcaggggaatctgggatgaaaataatcaggatgagattataagtctgtttcaggagatgaaacaacataatgagacagggcttctgccccgctatattattgtaaacggagcaaatgaacatttgaatgtgtctggaagaggagtcttacatatcgcatttccgattaagaatggctataattataaaaatatgaaatacatgattatcgtttcttattacagtcagccaatttcatctttgttaaaacagctttctcaggggggaaaagatgagtttttacagggatatattgaaaatgccagtggaaagattttgtttcataccgacgaaaattatgtggataaaaacgcaaaaaagatttataatagtgacacgaataaaatcaatctggaaacggatgtggaaaattatggatggaagctgcatggtgtgattgacaaagctgctttagagtcaaacgtaaacaaaatgtactctaaggcgatgattttgtatttgtgtgcgattttggccgtaatggggattgcaatttttattattaagt

(The sequence listing continues in the following parts.)

The invention claimed is:

1. A method of treating repetitive, stereotyped, compulsive, or anxious behavior caused by a neurodevelopmental disorder or a neuropsychiatric condition in a subject in need thereof, comprising administering to said subject a pharmaceutical composition that comprises a therapeutically effective amount of a bacteria strain of the genus Blautia comprising a 16S rRNA gene sequence of SEQ ID NO:2 or SEQ ID NO:4, wherein said administering is effective to treat said behavior in said subject.

2. The method of claim 1, wherein said subject has said neurodevelopmental disorder, and wherein said neurodevelopmental disorder is an autism spectrum disorder (ASD) or a child developmental disorder.

3. The method of claim 2, wherein said subject has said ASD, and wherein said ASD is autism or Asperger Syndrome.

4. The method of claim 1, wherein said subject has said neuropsychiatric condition, and wherein said neuropsychiatric condition is selected from the group consisting of obsessive compulsive disorder (OCD), major depressive disorder, seasonal affective disorder, an anxiety disorder, chronic fatigue syndrome, post-traumatic stress disorder, a schizophrenia spectrum disorder, bipolar disorder, psychosis, and mood disorder.

5. The method of claim 4, wherein said subject has said schizophrenia spectrum disorder, and wherein said schizophrenia spectrum disorder is schizophrenia.

6. The method of claim 4, wherein said subject has said anxiety disorder, and wherein said anxiety disorder is selected from the group consisting of generalized anxiety disorder (GAD), specific phobia, social anxiety disorder, separation anxiety disorder, agoraphobia, panic disorder, and selective mutism.

7. The method of claim 1, wherein said bacteria strain is live and capable of at least partially colonizing an intestine of said subject.

8. The method of claim 1, wherein said pharmaceutical composition is formulated for delivery to an intestine of said subject.

9. The method of claim 1, wherein said bacteria strain is of the species *Blautia stercoris* or *Blautia wexlerae*.

10. The method of claim 1, wherein said bacteria strain is the bacteria strain deposited under accession number NCIMB 42381 or the bacteria strain deposited under accession number NCIMB 42486.

11. The method of claim 1, wherein said subject is human.

12. A method of treating behaviors in a subject suffering from a neurocognitive disorder, comprising administering to said subject a pharmaceutical composition that comprises a therapeutically effective amount of a bacteria strain of the genus *Blautia* comprising a 16S rRNA gene sequence of SEQ ID NO:2 or SEQ ID NO:4, wherein said administering is effective to treat said behaviors in said subject.

13. The method of claim 12, wherein said neurocognitive disorder is selected from the group consisting of Alzheimer's disease, vascular dementias, Lewy body disease, frontotemporal dementia, Parkinson's disease, Creutzfeldt-Jakob disease, Huntington's disease, and Wernicke-Korsakoff syndrome.

* * * * *